US010894981B2

(12) United States Patent
Urayama et al.

(10) Patent No.: US 10,894,981 B2
(45) Date of Patent: Jan. 19, 2021

(54) METHOD FOR FRAGMENTING DOUBLE-STRANDED RNA AND USE OF THE SAME

(71) Applicant: JAPAN AGENCY FOR MARINE-EARTH SCIENCE AND TECHNOLOGY, Yokosuka (JP)

(72) Inventors: Shunichi Urayama, Yokosuka (JP); Takuro Nunoura, Yokosuka (JP); Shigeru Deguchi, Yokosuka (JP)

(73) Assignee: JAPAN AGENCY FOR MARINE-EARTH SCIENCE AND TECHNOLOGY, Yokosuka (JP)

( * ) Notice: Subject to any disclaimer, the term of this patent is extended or adjusted under 35 U.S.C. 154(b) by 321 days.

(21) Appl. No.: 15/767,832

(22) PCT Filed: Oct. 13, 2016

(86) PCT No.: PCT/JP2016/080306
§ 371 (c)(1),
(2) Date: Apr. 12, 2018

(87) PCT Pub. No.: WO2017/065194
PCT Pub. Date: Apr. 20, 2017

(65) Prior Publication Data
US 2018/0298437 A1   Oct. 18, 2018

(30) Foreign Application Priority Data
Oct. 13, 2015  (JP) ................. 2015-202234

(51) Int. Cl.
*C12Q 1/6869*  (2018.01)
*G16B 30/00*   (2019.01)
*C12N 15/09*   (2006.01)
*G01N 33/53*   (2006.01)
*C12Q 1/68*    (2018.01)
*G01N 33/569*  (2006.01)
*C12N 7/02*    (2006.01)
*C12N 15/10*   (2006.01)
*C12P 19/34*   (2006.01)
*C12N 7/00*    (2006.01)
*C40B 50/06*   (2006.01)

(52) U.S. Cl.
CPC ............ *C12Q 1/6869* (2013.01); *C12N 7/02* (2013.01); *C12N 15/09* (2013.01); *C12N 15/1096* (2013.01); *C12P 19/34* (2013.01); *C12Q 1/68* (2013.01); *G01N 33/53* (2013.01); *G01N 33/569* (2013.01); *G16B 30/00* (2019.02); *C12N 7/00* (2013.01); *C40B 50/06* (2013.01)

(58) Field of Classification Search
CPC ...... C12N 15/09; C12N 15/1096; C12N 7/00; C12N 7/02; C12P 19/34; C12Q 1/68; C12Q 1/6869; C40B 50/06; G01N 33/53; G01N 33/569; G16B 30/00
See application file for complete search history.

(56) References Cited

U.S. PATENT DOCUMENTS

| 2007/0031865 | A1* | 2/2007 | Willoughby | ....... C12N 15/1096 435/6.1 |
| 2010/0279302 | A1* | 11/2010 | Segal | ................... C12Q 1/6869 435/6.11 |
| 2011/0020289 | A1 | 1/2011 | Moriyama et al. | |
| 2014/0037586 | A1 | 2/2014 | Moriyama et al. | |
| 2014/0155274 | A1* | 6/2014 | Xie | .................... C12N 15/1065 506/2 |

FOREIGN PATENT DOCUMENTS

| EP | 2679675 B1 | 3/2017 |
| JP | 2008-545384 A | 12/2008 |
| JP | 2009-508495 A | 3/2009 |
| JP | 2009-247301 A | 10/2009 |
| WO | 2004/018493 A1 | 3/2004 |
| WO | 2004/018497 A2 | 3/2004 |
| WO | 2004/018497 A3 | 3/2004 |
| WO | 2004/050915 A1 | 6/2004 |
| WO | 2004/076692 A1 | 9/2004 |
| WO | 2005/021786 A1 | 3/2005 |
| WO | 2005/047301 A1 | 5/2005 |
| WO | 2005/065814 A1 | 7/2005 |
| WO | 2005/068089 A2 | 7/2005 |

(Continued)

OTHER PUBLICATIONS

Chen et al., Journal of Virological Methods, 39, 197-206, (Year: 1992).*
Urayama, S-I, et al., "Unveiling the RNA virosphere associated with marine microorganisms", Molecular Ecology Resources, Sep. 6, 2018, vol. 18, No. 6, pp. 1444-1455, XP055548014; cited in EESR dated Feb. 18, 2019.
Urayama, S-I, et al., "FLDS: A Comprehensive dsRNA Sequencing Method for Intracellular RNA Virus Surveillance", Microbes and Environments, Jan. 1, 2016, vol. 31, No. 1, pp. 33-40, XP055548427; cited in EESR dated Feb. 18, 2019.

(Continued)

*Primary Examiner* — Cynthia B Wilder
(74) *Attorney, Agent, or Firm* — Westerman, Hattori, Daniels & Adrian, LLP

(57) ABSTRACT

The object is to provide a method that enables detection of unknown virus sequences and efficient detection and search of viruses. The method comprises the step of randomly fragmenting an objective double-stranded (ds) RNA to obtain dsRNA fragments; the step of subjecting the obtained dsRNA fragments to a reverse transcription reaction and then performing polymerase chain reaction (PCR) to obtain corresponding DNA fragments; and the step of subjecting the obtained DNA fragments to a sequence analysis operation to determine the sequences. The reverse transcription reaction is preferably started from the 3' ends of the dsRNA fragments.

13 Claims, 30 Drawing Sheets
Specification includes a Sequence Listing.

(56) References Cited

FOREIGN PATENT DOCUMENTS

| WO | 2005/068089 A3 | 7/2005 |
|---|---|---|
| WO | 2005/068656 A1 | 7/2005 |
| WO | 2005/078130 A1 | 8/2005 |
| WO | 2005/095647 A1 | 10/2005 |
| WO | 2006/123154 A2 | 11/2006 |
| WO | 2006/123154 A3 | 11/2006 |
| WO | 2007/035742 A2 | 3/2007 |
| WO | 2007/035742 A3 | 3/2007 |

OTHER PUBLICATIONS

Decker, C. J. et al., "Analysis of Double-Stranded RNA from Microbial Communities Identifies Double-Stranded RNA Virus-like Elements", Cell Reports, May 1, 2014, vol. 7, No. 3, pp. 898-906, XP055548135; cited in EESR dated Feb. 18, 2019.

Extended (supplementary) European Search Report dated Feb. 18, 2019, issued in counterpart EP Application No. 16855447.5. (8 pages).

"Effect of Fragmentation on Interferon Induction by Double-stranded Virus RNA", J.Gen. Virol, 1974, pp. 191-195; cited in the Specification.

Urayama, S. et al, "A New Fractionation and Recovery Method of Viral Genomes Based on Nucleic Acid Composition and Structure Using Tandem Column Chromatography", Microbes Environ., 2015, vol. 30, No. 2, pp. 199-203; cited in the Specification.

Urayama, S. et al., "FLDS: A Comprehensive dsRNA Sequencing Method for Intracellular RNA Virus Surveillance", Microbes Environ., 2016, vol. 31, No. 1, pp. 33-40; cited in the Specification.

Rutvisuttinunt, W. et al., "Simultaneous and complete genove sequencing of influenza A and B with high coverage by Illumina MiSeq Platform", Journal of Virological Methods, 2013, vol. 193, pp. 394-404; cited in ISR and Written Opinion dated Jan. 10, 2017; IPRP dated Apr. 26, 2018; and Japanese Office Action dated Feb. 27, 2018.

Wenbin, C. et al., "A simple and rapid method of preparing large fragments of dengue virus of cDNA from replicative-form RNA suing reverse transcriptase and PCR", Journal of Virological Methods, 1992, vol. 39, pp. 197-206; cited in ISR and Written Opinion dated Jan. 10, 2017; IPRP dated Apr. 26, 2018; and Japanese Office Action dated Feb. 27, 2018.

International Search Report and Written Opinion dated Jan. 10, 2017, issued in counterpart International Application No. PCT/JP2016/080306. (10 pages).

Notification of Transmittal of Translation of the International Preliminary Report on Patentability (Form PCT/IB/338) issued in counterpart International Application No. PCT/JP2016/080306 dated Apr. 26, 2018, with Forms PCT/IB/373, PCT/IB/326 and PCT/ISA/237, with English translation. (14 pages).

Office Action dated Feb. 27, 2018, issued in counterpart Japanese Application No. 2017-545445, with English machine translation. (6 pages).

Koyama, S. et al., "A new member of the family Totiviridae associated with arboreal ants (*Camponotus nipponicus*)", Archives of Virology, 2016, vol. 161, No. 7, pp. 2043-2045.

Takai, K., "Virologists are "Symbionts" in Microbial Ecology", Microbes and Environment, 2016, vol. 31, No. 4, pp. 367-368.

Office Action dated Oct. 17, 2019, issued in counterpart EP Application No. 16 855 447.5. (5 pages).

* cited by examiner

[Figure 1]
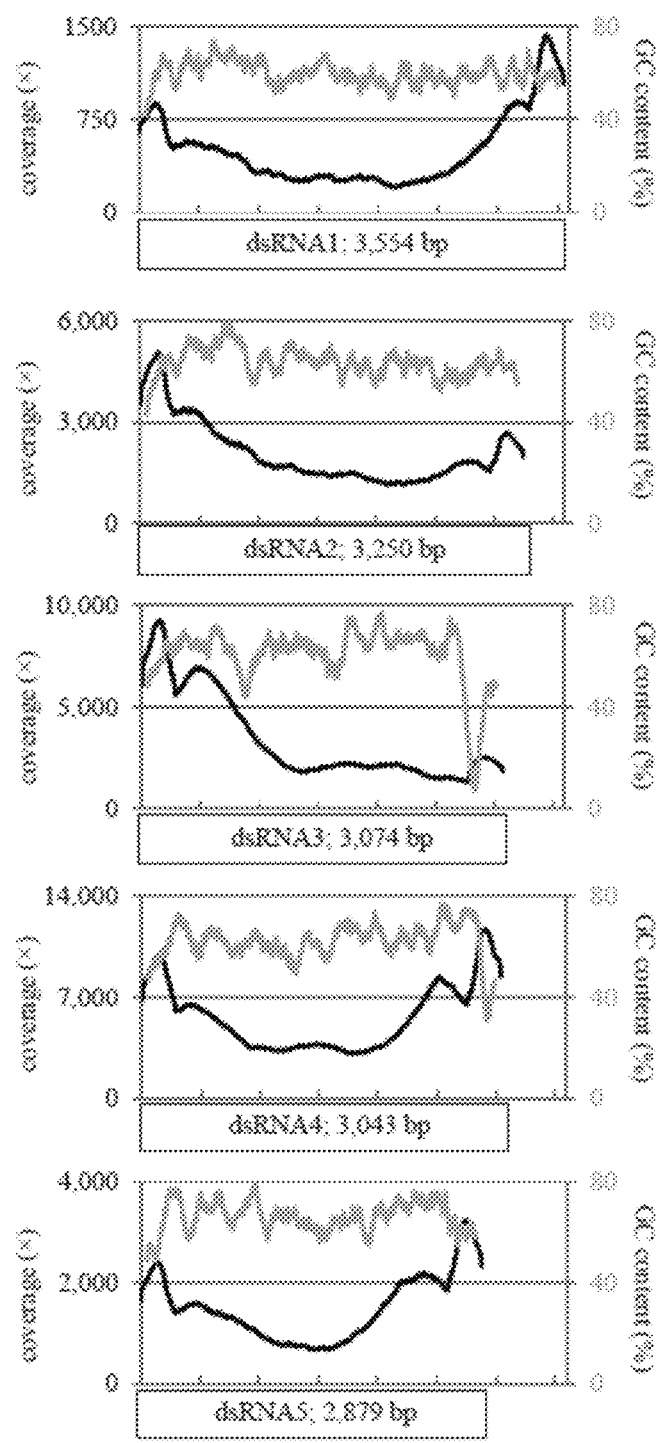

[Figure 2]
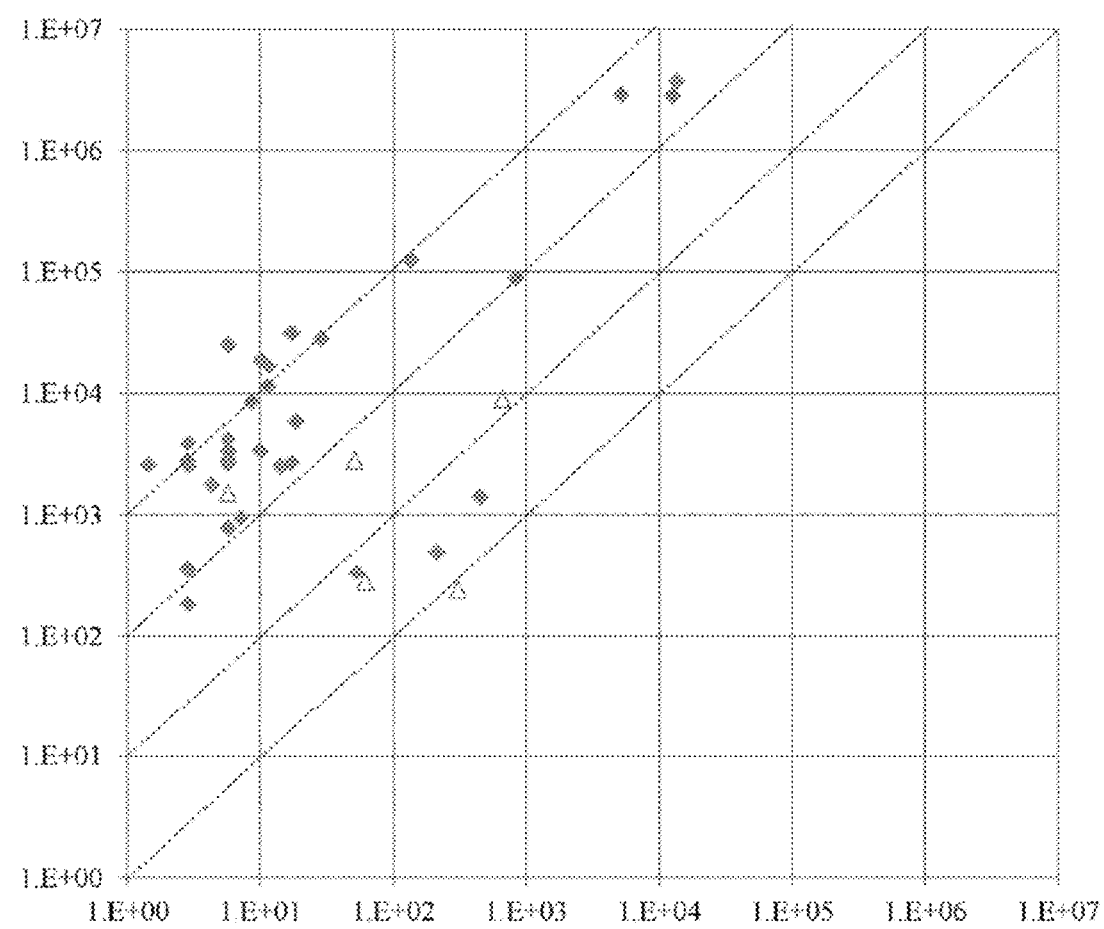

[Figure 3]
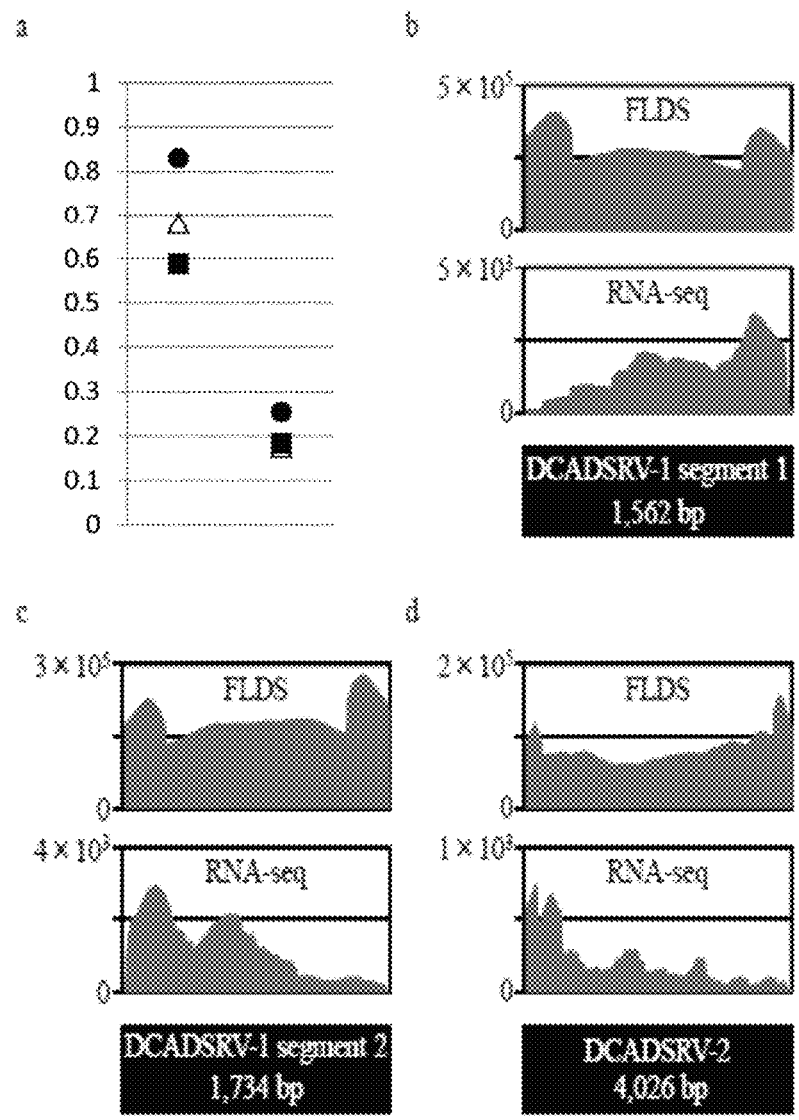

[Figure 4A]

| | | | |
|---|---|---|---|
| 1 GAAUAACUU | | GAAACGUC | 4777 |
| 1 GAAUAUUCU | | GAAACAUCA | 4334 |
| 1 GAAUAUUUU | | UGGAACAUC | 4227 |
| 1 GAAUAACAU | | AAAACGUC | 3624 |
| 1 GAAUAUUAU | | UGAAACAUC | 3472 |
| 1 GAAUAUUAU | | UGAAACAUC | 3459 |
| 1 GAAUAUUAC | | UGUAACAUC | 3426 |
| 1 GAAUUUGAA | | AGAAACGUC | 2910 |
| 1 GAAUAUUGA | | GAAACGUC | 2614 |
| 1 GAAUUUUGA | | UGAAACAUC | 2490 |
| 1 GAAUAAUGA | | GGAAACAUC | 2439 |
| 1 GAAUAUUGA | | UGUAACAUC | 2255 |
| 1 GAAUUUGAU | | AGAAACAUC | 2198 |
| 1 GAAUAAAAU | | UGAAACAUC | 2116 |
| 1 GAAUAUAAU | | UGAAACAUC | 2092 |
| 1 GAAUAUAAA | | UGAAACAUC | 2092 |
| 1 GAAUAUUUU | | UGAAACAUC | 2087 |
| 1 GAAUAAAAG | | UCGAACGUC | 2073 |
| 1 GAAUAUAAA | | UGAAACAUC | 2054 |
| 1 GAAUAUAAU | | UGAAACAUC | 2045 |
| 1 GAAUAUUGA | | UGAAACAUC | 2025 |
| 1 GAAUAAUAU | | AUUUGCUC | 2010 |
| 1 GAAUAUUGU | | AUGAACAUC | 1933 |
| 1 GAAUAAACA | | GGAAACGUC | 1808 |
| 1 GAAUAAGUU | | GAAACGUC | 1726 |
| 1 GAAUAUUAU | | UGAAACAUC | 1714 |
| 1 GAAUAUUAU | | UGAAACAUC | 1581 |
| 1 GAAUAUUGU | | AUGAACAUC | 1576 |
| 1 GAAUAUUGU | | AUGAACAUC | 1576 |
| 1 GAAUAGAAA | | GUAAACAUC | 1564 |
| 1 GAAUUUAAA | | AGUAACAUC | 1551 |
| 1 GAAUAUUAU | | UGAAACAUC | 1520 |
| 1 GAAUAGAAA | | GGUAACAUC | 1518 |
| 1 GAAUAUUAU | | UGAAACAUC | 1425 |
| 1 GAAUUAUUU | | UGAAACAUC | 1424 |
| 1 GAAUAUUUU | | UGAAACAUC | 1408 |
| 1 GAAUAUUGU | | GAAACAUC | 1403 |
| 1 GAAUAUUAU | | UGAAACAUC | 1396 |
| 1 GAAUAUUUU | | UGAAACAUC | 1389 |
| 1 GAAUAUUUU | | UGAAACAUC | 1380 |
| 1 GAAUAUUUC | | UGAAACAUC | 1351 |
| 1 GAAUAUUAU | VP11 | UGAAACAUC | 1337 |
| 1 GAAUAUUAC | VP11 | UGAAACAUC | 1333 |
| 1 GAAUAUUAC | VP11 | UGAAACAUC | 1333 |

[Figure 4B]

| | | | |
|---|---|---|---|
| 1 GAAUAUUCU | | | UGAAACAUC 1255 |
| 1 GAAUAUUCU | | | UGAAACAUC 1099 |
| 1 GAAUAUUCU | | | UGAAACAUC 1043 |
| 1 GAAUAAGUU | | | GAAAACGUC 1027 |
| 1 GAAUAUUCU | | | UGAAACAUC 1017 |
| 1 GAAUACGG | | | ACAAACAUC 1010 |
| 1 GAAUAUUAU | | VP11 | UGAAACAUC 983 |
| 1 GAAUAUUU | | | AUGAACAUC 938 |
| 1 GAAUAUUUU | | | ACGAACAUC 928 |
| 1 GAAUAUUUU | | | UGAACAUAC 918 |
| 1 GAAUAUUGA | | | UGUAACAUC 912 |
| 1 GAAUAUUUU | | | AUGAACAUC 905 |
| 1 GAAUAAAUC | | | GAAAACGUC 904 |
| 1 GAAUAUUGA | | | UGGAACAUC 898 |
| 1 GAAUAUUGU | | | UGUAACAUC 895 |
| 1 GAAUAUUCU | | | UGAAACAUC 876 |
| 1 GAAUAUUAU | | | ACAAACAUC 834 |
| 1 UAAAAUCUU | | VP4 | UUUUGAAAU 2285 |
| 1 UUCAUAGCU | | VP2 | AUAACAAUC 2114 |
| 1 GGGUAGUGU | | RdRp | CUGAUAACA 1301 |
| 1 GUAAAAUUU | | RdRp | UGCUAUCCC 2109 |
| 1 GUAAAAUAA | | RdRp | CCUUCCAC 2021 |
| 1 GUAAAAUUA | | | CUAAACUUU 1910 |
| 1 GUAAAAUUU | | | CAAAACUUU 1910 |
| 1 GUAAAAUAU | | | GGGCCCCC 1847 |
| 1 GUAAAAUAA | | | CCUUGUUCC 1820 |
| 1 GUAAAAUAA | | | CGCGCUCCC 1722 |
| 1 GUAAAAUAA | | | GCGUCAUCC 1660 |
| 1 GUAAAAUUU | | | ACUAUACCC 1488 |
| 1 GUAAAUAAA | | RdRp | CUACCUAGG 1723 |
| 1 GUAAAUAAU | | RdRp | UGCUCCAUC 1651 |

[Figure 4C]

| | | |
|---|---|---|
| 1 GGGAUUUAA | | UCGAUGACA 3732 |
| 1 GGGAUUUUU | | ACAACAGAC 3037 |
| 1 GGGAUUUUU | | UAUAUAACA 3031 |
| 1 GGGAUUAAA | | AUGAUAACA 2775 |
| 1 GGGAUUUUU | | AUACAGACC 1964 |
| 1 GGGAUUUUU | | UCAAAAACA 1953 |
| 1 GGGAUUUUU | | AAACAGACC 1952 |
| 1 GGGAUUUUU | | AUACAGACC 1735 |
| 1 GGGAUUUUU | | UAUUGUACA 1679 |
| 1 GGGAUUUUU | | AUACAGACC 1670 |
| 1 GGGAUUUUA | | UAACAGACC 1509 |
| 1 GGGAUUUAA | | AUAACAGAC 1480 |
| 1 GGGAUUUUU | | AUACAGACC 1309 |
| 1 GGGAUUUUU | | AAACAGACC 1240 |
| 1 GGGAUUUUU | | UUACAGACC 1207 |
| 1 GGGAUUUUU | | GAAACAGAC 1159 |
| 1 GGGAUAAUU | | UAGUGGAUA 1150 |
| 1 GGGAUUUUU | | AAACAGACC 1108 |
| 1 GGGAUUUUU | | AAACAGACC 933 |
| 1 GGGAUUUUU | | AAACAGACC 928 |
| 1 GGGAUUUAU | | GUCGUAAA 919 |
| 1 GGGAUUUAA | | UAACAGACC 908 |
| 1 GGGAUUUAA | | UGACAGACC 813 |
| 1 GGUAUAAAA | | UAACUGACC 3740 |
| 1 GGUAUAAAA | | AAUCCUGAC 3100 |
| 1 GGUAUAAAA | capping enzyme | ACAAUGACC 2339 |
| 1 GGUAUAAAA | | AAAACUGAC 2010 |
| 1 GGUAUAAAA | | AAACAGACC 1622 |
| 1 GGUAUAAAA | | AAUCCGACC 1584 |
| 1 GUAUAAAU | | AAACAGACC 1158 |
| 1 GGUAUAAAA | | UGACCGACC 1140 |
| 1 GGUAUAAAA | | UAACCGACC 1031 |
| 1 GGUAUAAAA | VP11 | GGAACUGAC 924 |
| 1 GGUAUAAAA | VP9 | GAACCGACC 917 |
| 1 GGUAUAAAA | VP12 | AACCAGACC 749 |

[Figure 4D]

| | | |
|---|---|---|
| 1 AUAAAUUUU | | AUCAACGAU 4306 |
| 1 GAUAAAUUA | | UCAACGAUC 2723 |
| 1 AUAAAUAUC | | AUCAACGAU 2708 |
| 1 AUAAAUUAC | | AUCAACGAU 2449 |
| 1 AUAACAUAC | | UUAAACAUC 2360 |
| 1 GAUAAAUUA | | UCAACGAUC 2183 |
| 1 AUAAAUUUC | | ACAACGAUC 2060 |
| 1 AUAAAUUUC | | AUCAACGAU 1534 |
| 1 AUAAAUAUC | | GUAAACGAU 1245 |
| 1 GAUAAAUUU | | UCAACGAUC 1212 |
| 1 AUAAACUUC | VP11 | AUCAACGAU 1178 |
| 1 AUAAAUUAC | | UCAACGAUC 1172 |
| 1 GAAGUCUUA | | UCAAAGAUC 4748 |
| 1 GAAGUCUAU | | UCAAAGAUC 3200 |
| 1 GAAGUUUUU | | AAGUGGAUC 2260 |
| 1 GAAGUUCUU | | GAGUUGAUC 2096 |
| 1 GAAGUUCUU | | GAGAAAGUC 1682 |
| 1 GAAGUCUCC | | GAGUUGAUC 1576 |
| 1 GAAGUUCUC | | UAAAAGAUC 1380 |
| 1 GAAGUUAUU | | AAGAAAAGU 1322 |
| 1 GAAGUUUAC | | GUAAAGAUC 1161 |
| 1 GAAGACUUC | | GUAAAGAUC 1112 |
| 1 GAAGAAUCC | | GUAAAGAUC 960 |
| 1 GUUAAAUAA | | UCGGGUCC 2397 |
| 1 GUUAAAUAA | | UUGGGUCCC 2120 |
| 1 GUUAAAUAA | | CUGUCUCCC 1794 |
| 1 GUUAAAUUA | | UGGGGUCCC 1626 |
| 1 GUAAAAAUU | | UCGUAUUAG 2155 |
| 1 GUAAAAAUU | | UGUUUUCCC 2145 |
| 1 GUAAAAAUU | | AAAUCUCCC 1490 |
| 1 GGGCAUCAG | | AAAAGACAC 3276 |
| 1 GGGCAUACU | | CCCUAUCCC 1444 |
| 1 GUUUUAAAA | | CUCAACCCC 1575 |
| 1 AGUUGAUAC | | ACGUUAUGC 1517 |

[Figure 5A]
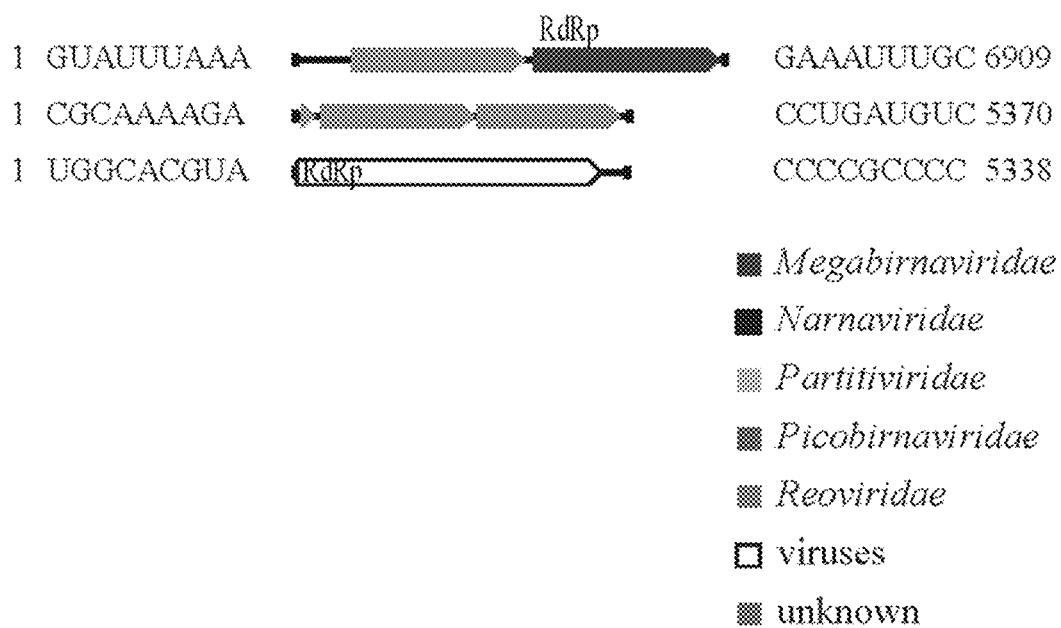

[Figure 5B]

| | | | | |
|---|---|---|---|---|
| 1 | AGAUAAAUU | RdRp RdRp | AAACCCCCC | 1852 |
| 1 | GGGGCCGCU | RdRp | CUUACAUU | 768 |
| 1 | AAUUUAAA | RdRp | AACCCCCC | 1544 |
| 1 | GAUAAGAUC | RdRp | GAUAAUACA | 1018 |
| 1 | UGGAUUUUC | CP | ACAAUGUCC | 1466 |
| 1 | GGAAAGAUU | RdRp | ACGAGAUCA | 1958 |
| 1 | GGAAAGAUU | | ACGAGACCA | 1738 |
| 1 | GAAACUAAA | RdRp | AAUUUGUUU | 1515 |
| 1 | GUGAGUUUA | RdRp | CGGUGAAUA | 1286 |
| 1 | GGGGCUGAG | RdRp | CUCAGCCCC | 2233 |
| 1 | GGGAACAAA | | CCACCCCCC | 2761 |
| 1 | GGGAAUUUA | RdRp | CUGGUACCC | 1824 |
| 1 | GGAAAAAUU | RdRp | CCCCCAUCC | 1631 |
| 1 | GGAAAAAUU | | CCCCUUCCC | 922 |
| 1 | GAGAAAGCA | RdRp | UCAGCCUUC | 2777 |
| 1 | CGAAGAGAG | RdRp | GCGGGCCCC | 1819 |
| 1 | AGCCAUGCA | hypothetical protein RdRp | GUGGUAUCA | 3131 |
| 1 | GGGCCAGCA | RdRp | GUGAAACUA | 1257 |
| 1 | AUAAUAUGU | RdRp | GUUUUGCCC | 1708 |

 *Megabirnaviridae*
 *Narnaviridae*
 *Partitiviridae*
 *Picobirnaviridae*
 *Reoviridae*
 viruses
 unknown

[Figure 5C]
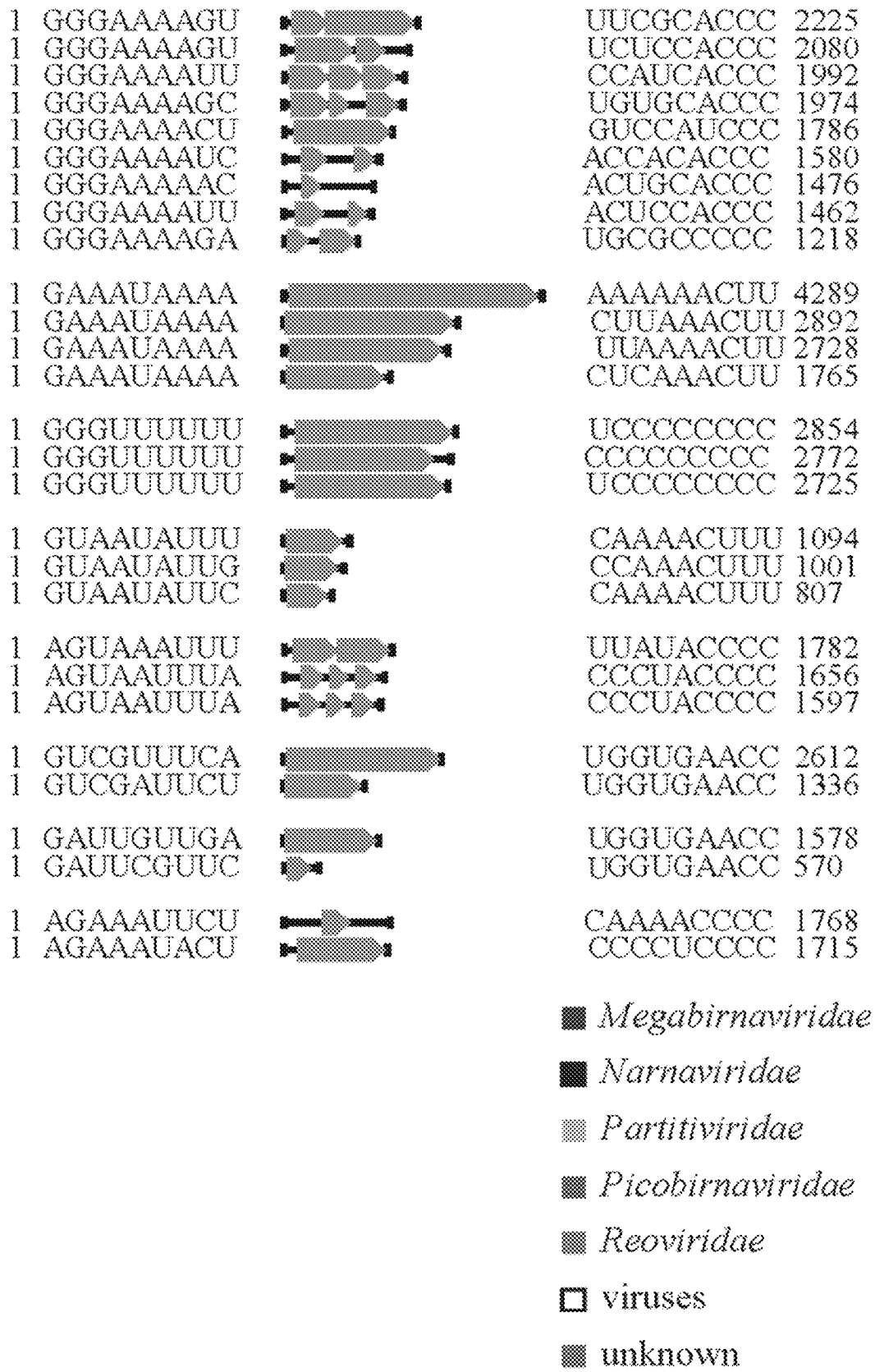

[Figure 5D]
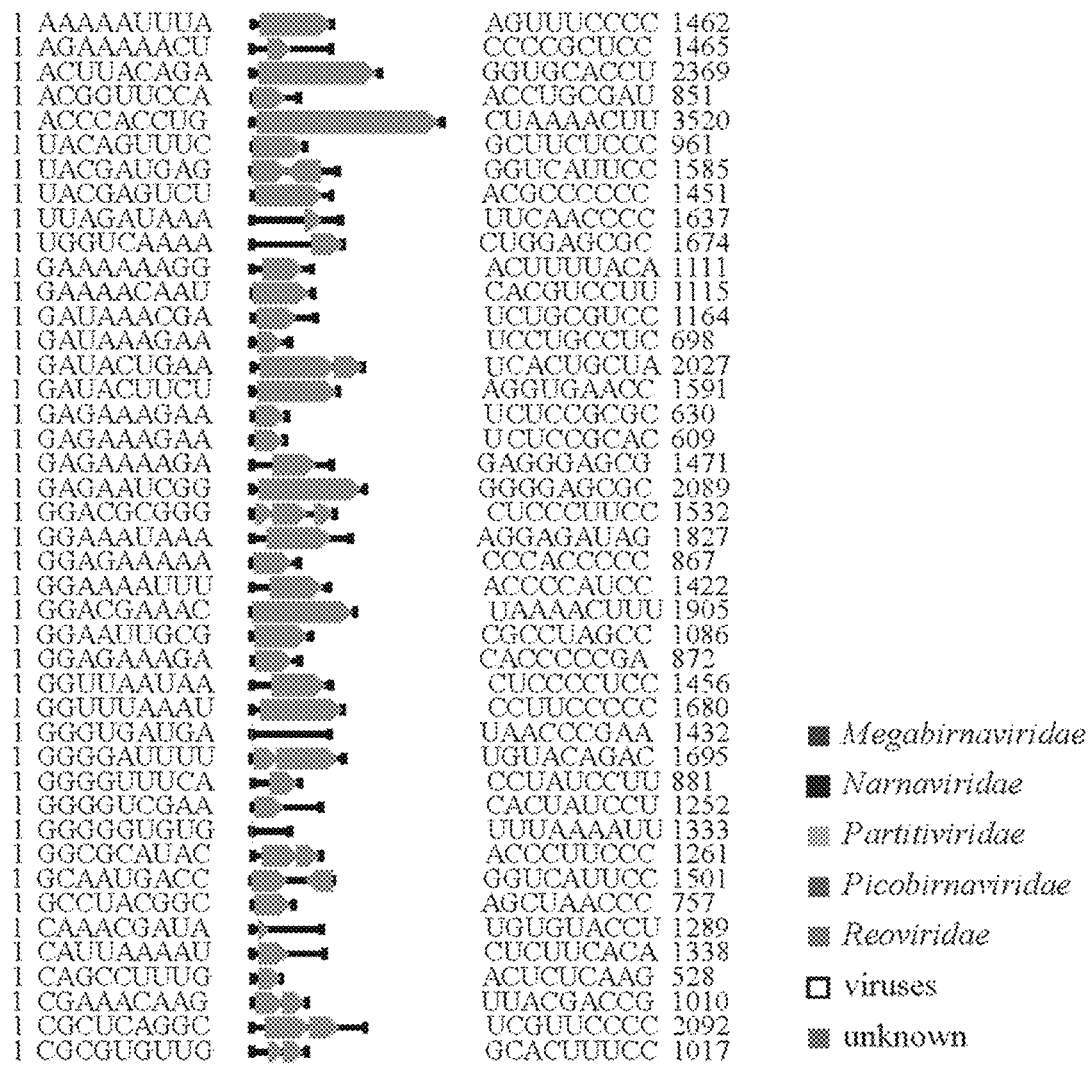

[Figure 6A]
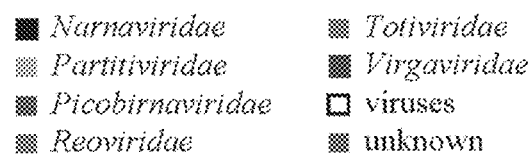
1 GAAUUUAA ··············· GGGCCCUUU 9835
1 CAUAAAAUA ··············· AAAAAAAAA 7527
1 GCAAAGAAA ········ UAAAAUUUU 5261
■ *Narnaviridae*　■ *Totiviridae*
▨ *Partitiviridae*　■ *Virgaviridae*
■ *Picobirnaviridae*　☐ viruses
■ *Reoviridae*　■ unknown

[Figure 6B]
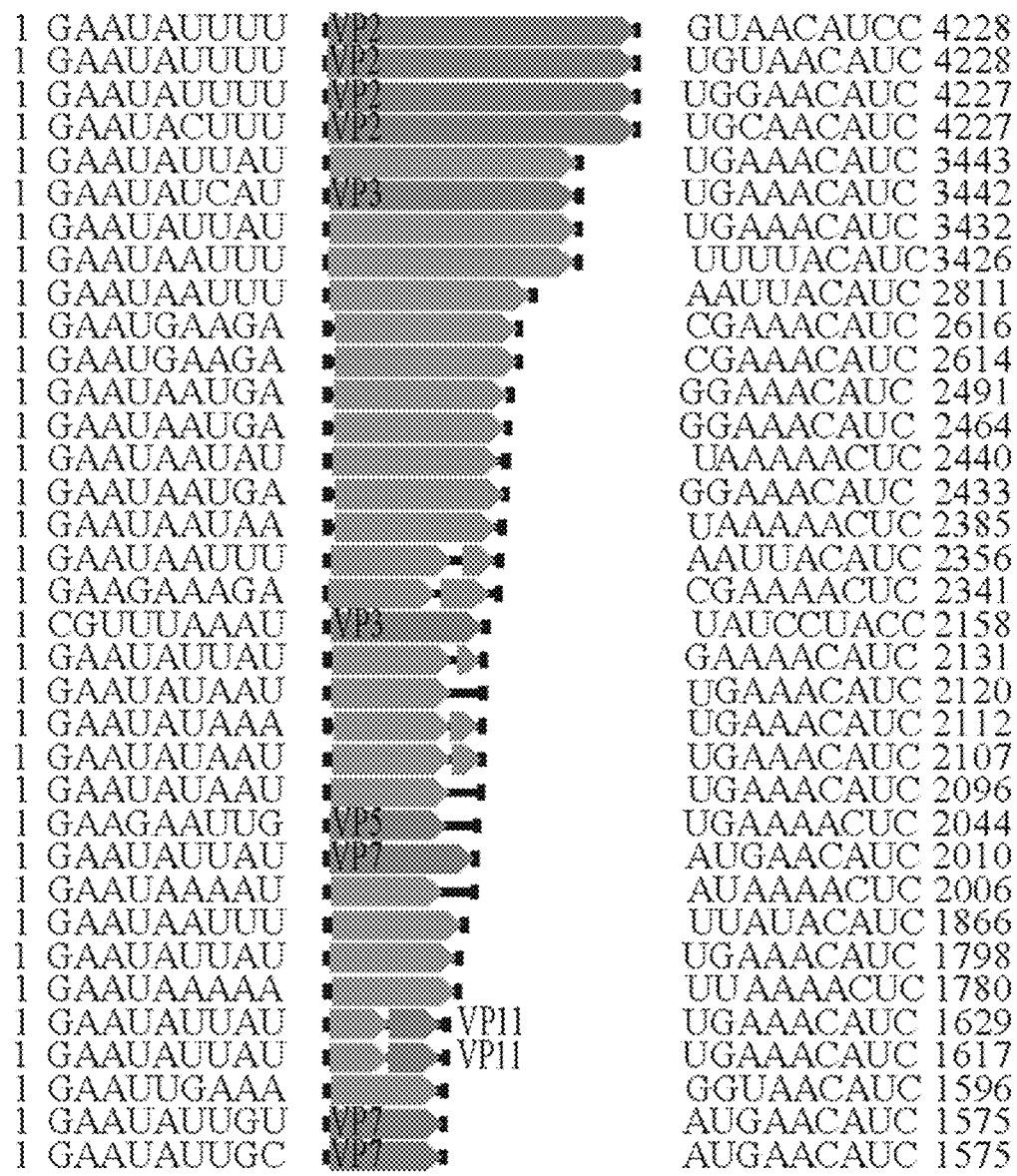

[Figure 6C]
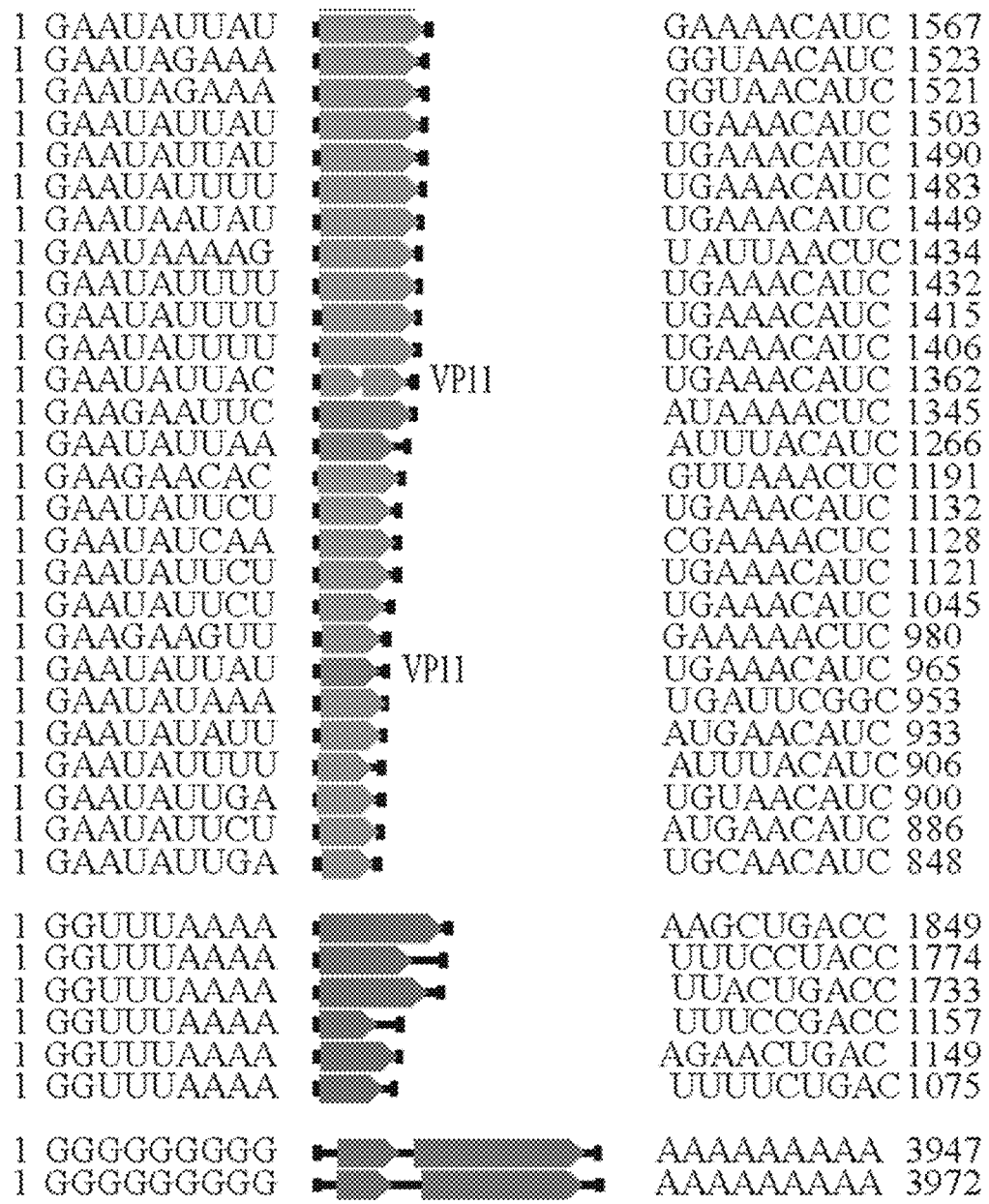

[Figure 6D]

| | | |
|---|---|---|
| 1 GUUAAAUUU | | UUACCCCCC 3770 |
| 1 GUAAAAUAU | | GAUCCCUCC 3621 |
| 1 GUAAAAUAU | | GAUCCCUCC 3613 |
| 1 GUAAAUUUU | | CUCCCCCCC 3554 |
| 1 GGAUUUUAU | | UACUGCCCC 3486 |
| | | |
| 1 GUAAAAAUU | | AACUAACCC 2079 |
| 1 GUAAAAACU | | UACCAGUUC 2071 |
| 1 GUAAAAACA | | GUUAAUCCU 2038 |
| 1 GUAAAAUAA | | UGCUACAUC 1674 |
| 1 GUAAAAUAA | | UCGCGCCCC 1761 |
| 1 GUAAACUU | | UCUGGUCUC 1683 |
| 1 GUAAAGAAA | | GUUAACCCC 2006 |
| 1 GUAAAUAAA | | AACCCCCCC 1736 |
| 1 GUAAAUAAA | | GGUGUUUU 1743 |
| 1 GUAAAUACA | | GUUAACCCC 2006 |
| | | |
| 1 GUUUUAAAU | | AUAACUCCU 1927 |
| 1 GUUUUAAAA | | CUCCACCUC 1740 |
| | | |
| 1 GUUUAAAAU | | CACCAUCCC 2204 |
| 1 GUUUAAAAC | | GUCUCCCCC 1821 |
| 1 GUUUAAAAU | | UCUUUUCCU 1725 |
| | | |
| 1 GUGAAUUAU | | ACCCAUCUC 1919 |
| 1 GUGAAACAA | | UCUGGCCUC 1702 |
| | | |
| 1 AAAUUUGAG | | ACGUGGCUU 2809 |
| 1 AAAUUUGAU | | UAAUGGGUU 1933 |
| | | |
| 1 GUAUAAAAC | | UUUCAGGUC 2089 |
| 1 GUAUAAAAU | | CAUGGCCAC 1700 |
| | | |
| 1 AGAAAAAGA | | CCCUCCUCU 1999 |
| | | |
| 1 GAUAAAUUA | | AGCAACCGC 1869 |

■ *Narnaviridae*   ▨ *Totiviridae*
▨ *Partitiviridae*  ■ *Virgaviridae*
■ *Picobirnaviridae* ☐ viruses
▨ *Reoviridae*    ▨ unknown

[Figure 6E]
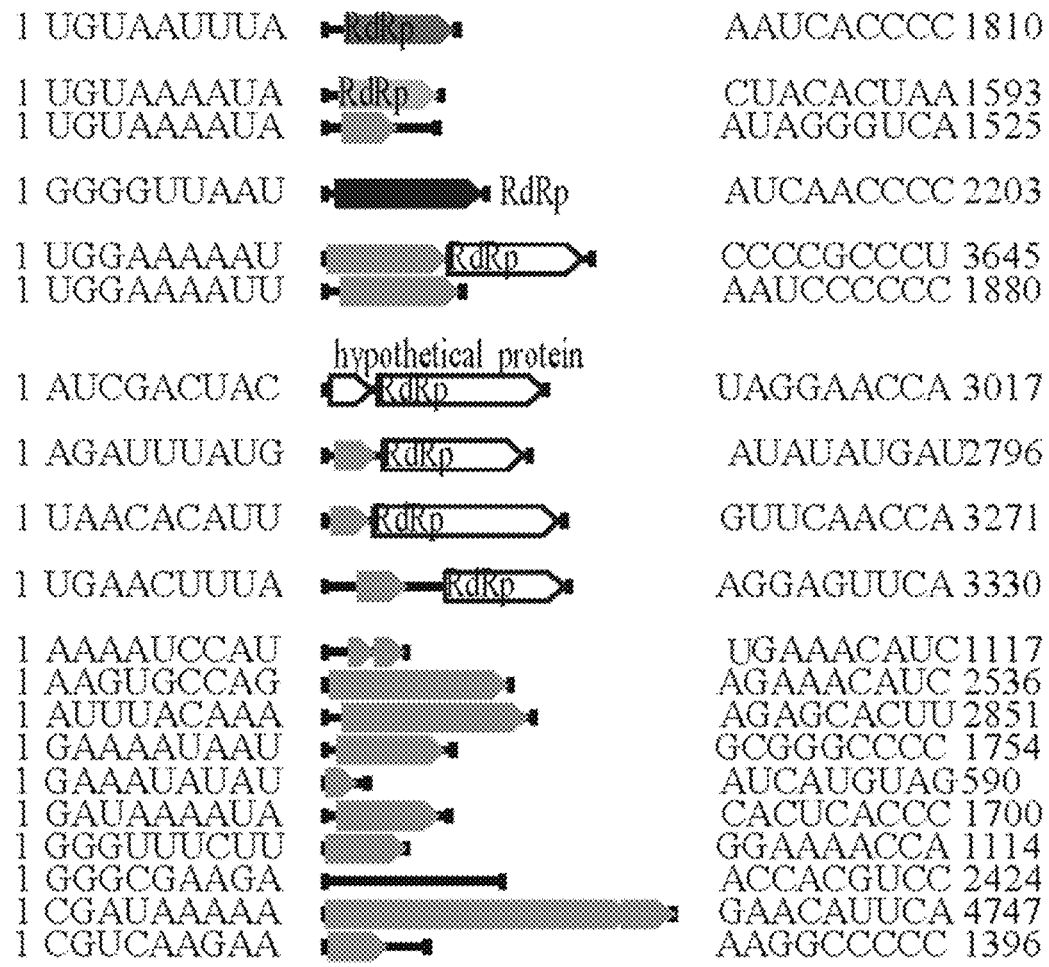
■ *Narnaviridae*     ▨ *Totiviridae*
▨ *Partitiviridae*     ■ *Virgaviridae*
■ *Picobirnaviridae*     ☐ viruses
▨ *Reoviridae*     ▨ unknown

[Figure 7A]

[Figure 7B]
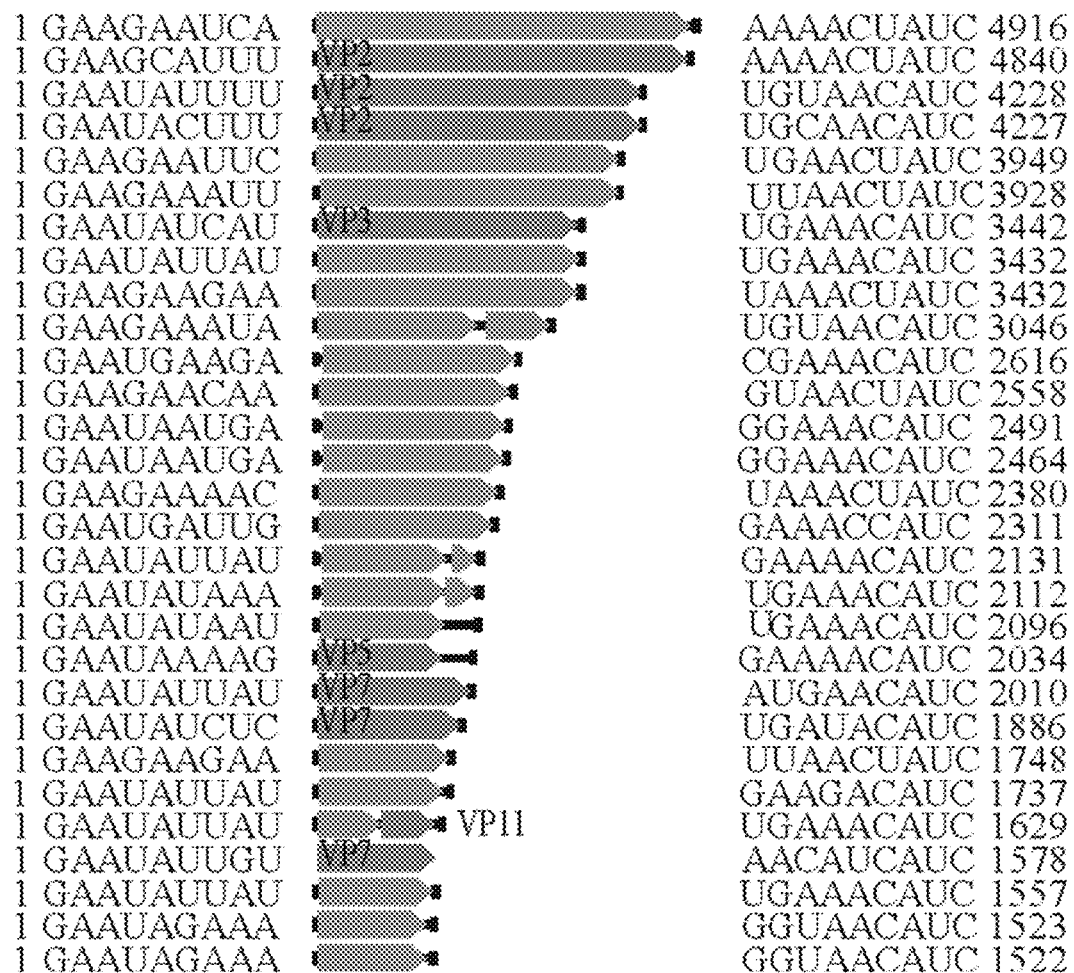

[Figure 7C]
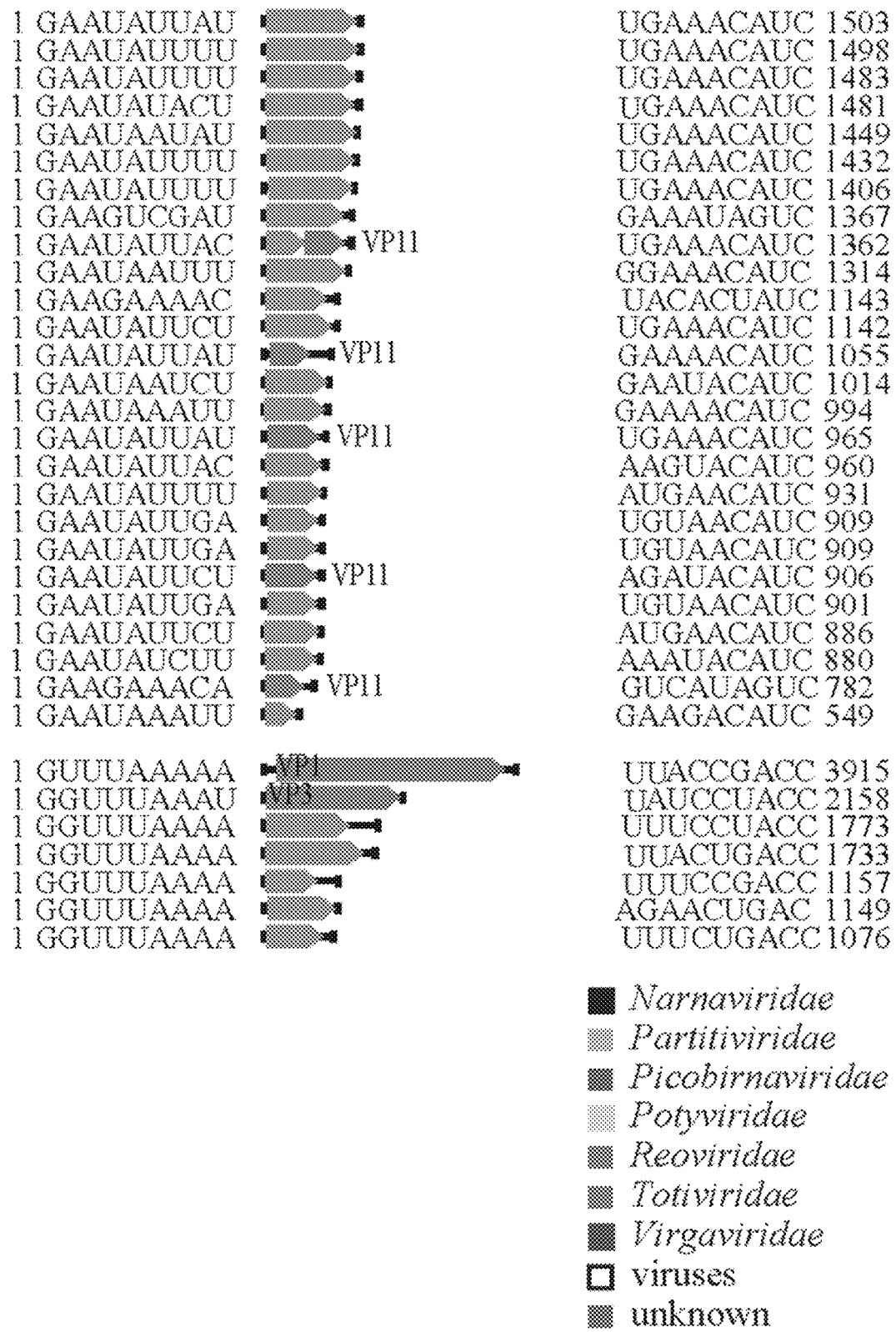

[Figure 7D]

| | | |
|---|---|---|
| 1 GUUAAAUUU | | UUACCCCC 3770 |
| 1 GUAAAAUAA | | UUACUCCUC 3577 |
| 1 GUAAAUUUU | | CUCCCCCC 3554 |
| 1 GUAAAAUAC | | ACUUCUCUC 3488 |
| 1 GUAUAAAAC | | UUUCAGGUC 2089 |
| 1 GUAUAAAAU | | CAUGGCCAC 1700 |
| 1 GUAAUUUAU | | AAUCACCCC 1809 |
| 1 GUAAAUAAA | | UGGUGUUUU 1742 |
| 1 GUAAAUAAA | | AACCCCCC 1742 |
| 1 GUAAACUU | | UCUGGUCUC 1683 |
| 1 GUAAAAACU | | UACCAGUUC 2071 |
| 1 GUAAAAUAA | | UCGCGCCCC 1761 |
| 1 GUAAAAUAA | | UGCUACAUC 1674 |
| 1 GUAAAAUUU | | UGCCACCCC 1761 |
| 1 GUUUUAAAA | | CUCCACCUC 1746 |
| 1 GUUUUAAAU | | AUAACUCCU 1925 |
| 1 GUUUAAAAU | | UCUUUUCCU 1725 |
| 1 GUGAAACAA | | UCUGGCCUC 1702 |
| 1 GUGAAUUAU | | ACCCAUCUC 1919 |
| 1 AAAUUUGAU | | UAAUGGGUU 1933 |
| 1 ACGAAAGAG | —RdRp— | UGGGGUUCG 2751 |
| 1 GGGCGAAGA | RdRp | ACCACGUCC 2424 |

■ *Narnaviridae*
▨ *Partitiviridae*
■ *Picobirnaviridae*
▨ *Potyviridae*
▨ *Reoviridae*
■ *Totiviridae*
■ *Virgaviridae*
☐ viruses
▨ unknown

[Figure 7E]
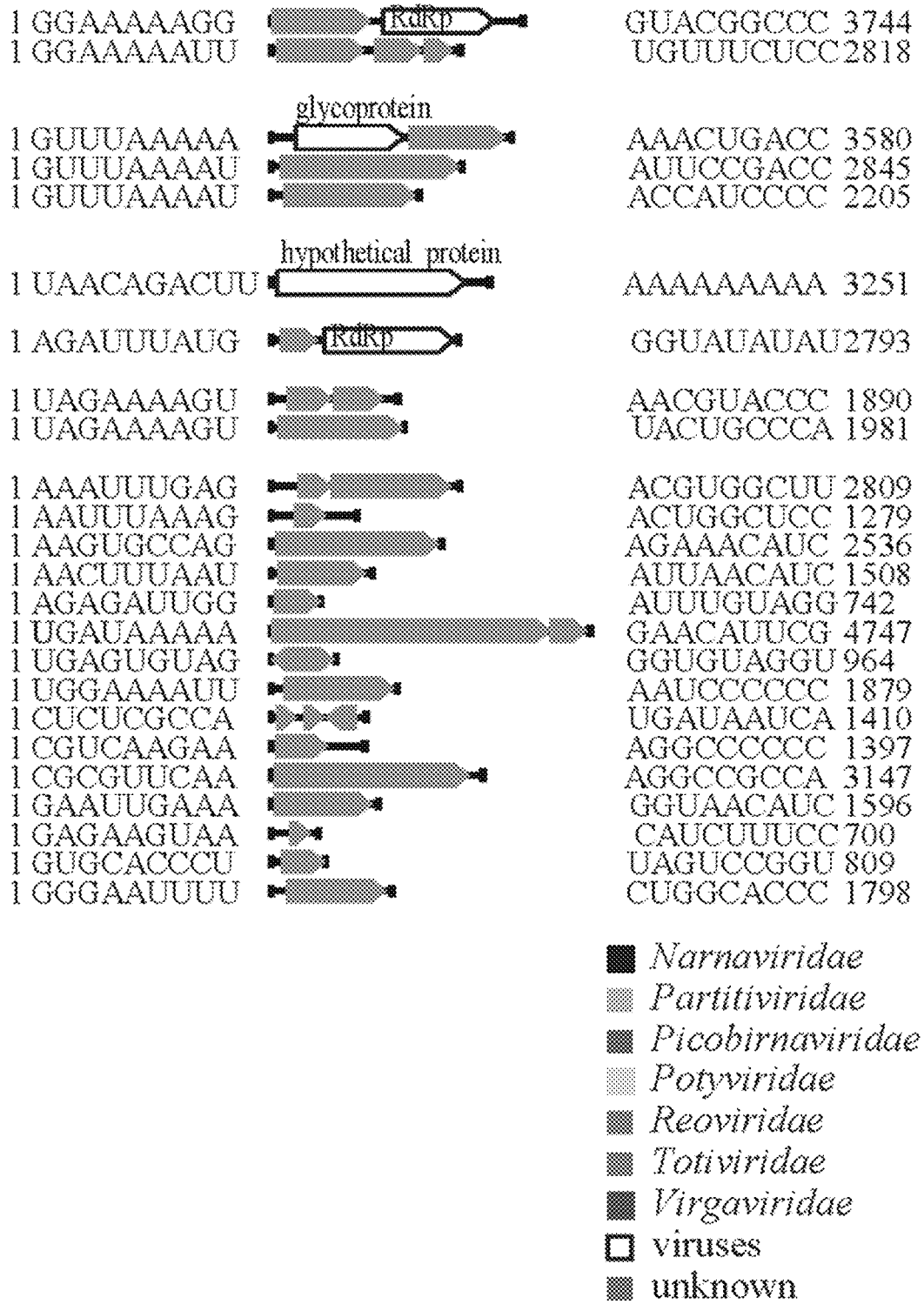

[Figure 8A]
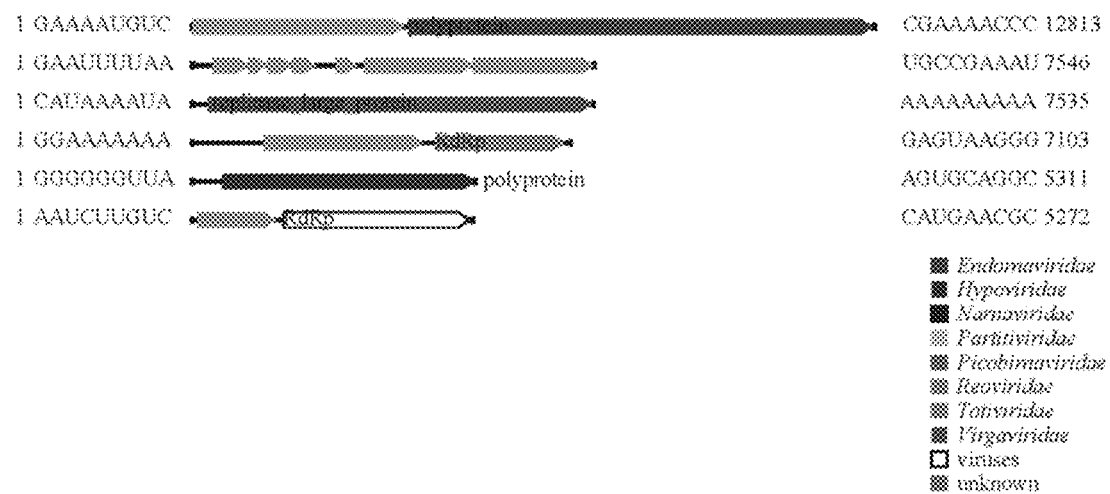

[Figure 8B]
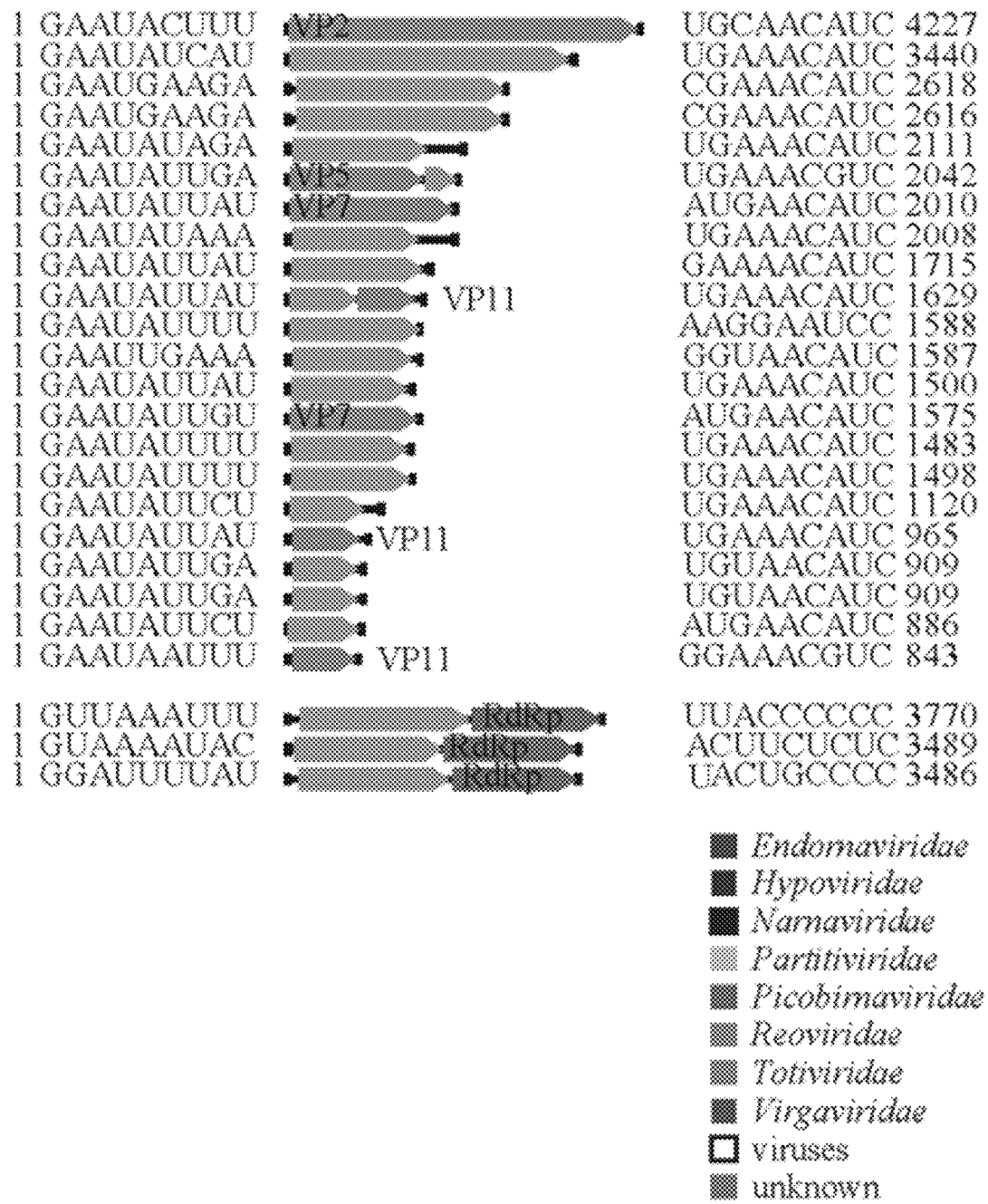

[Figure 8C]
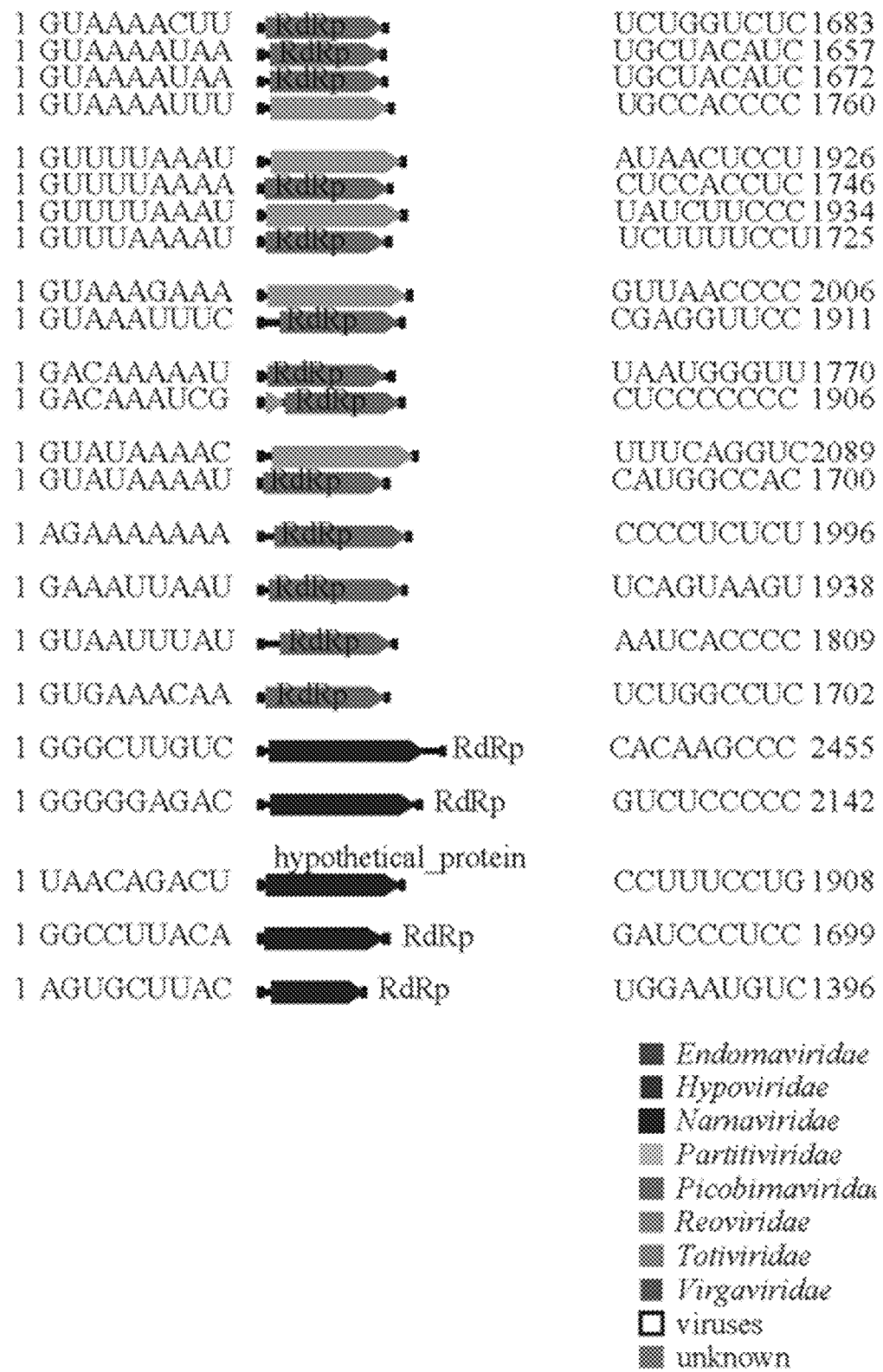

[Figure 8D]

| | | |
|---|---|---|
| 1 UGAAAGGUC | ━━━▬RdRp▬━━━ | CACUAUGCG 3403 |
| 1 UUCGUGGGG | ━━━▬RdRp▬━━━ | CGGACUUUU 2892 |
| 1 AGAUUAUG | ━━▬RdRp▬━━ | AUAUAUGAU 2796 |
| 1 GGGGAGGGA | ━▬nonstructural_protein▬━ | UCGUUUUU 704 |
| 1 CAAUACCCU | ▬▬ RdRp | CAGGCAGAU 926 |
| 1 GUGGUAUGC | ▬▬ RdRp | UCGUAGACC 1008 |
| 1 CAGGAUGGG | ▬ RdRp | CUACACUAA 808 |
| 1 UGGAAAAAU | ━━━▭RdRp▭━ | CCCCGCCCU 3645 |
| 1 UAACACAUU | ━━▭RdRp▭━ | CGUUCAACC 3270 |
| 1 AUCAACCAG | ▭RdRp▭━━━━ | AUACUAGCA 3003 |
| 1 CAACUUAUG | ▭67_kDa_protein▭ | GGAUACCCA 1767 |
| 1 GAUGUACUU | ▭175_kDa_protein▭ | CCAUCACCC 1170 |
| 1 GCACGGGGA | ▬▭RdRp ▬ | GCAAUACCA 1128 |
| 1 GCAGACAGA | ◇67_kDa_protein◇ | UCACCCCGG 629 |
| 1 UGAAUAAAU | ━━━━━ | UUUGGCCCC 2056 |
| 1 UGUAAAUAA | ▬▬▬▬ | AACCCCCCC 1744 |
| 1 GAUAAAGAA | ▬▬ | CCGUAACGG 1141 |
| 1 GAGACAUAC | ▬▬▬ | CUGAAACCC 2115 |
| 1 GACUUUAAA | ▬▬▬▬ | GGCCCCCC 2638 |
| 1 GGUCAAGAA | ▬▬ | GAAGGCCCC 1395 |
| 1 CGAACUUUU | ▬ | CUGAAACCC 781 |

■ *Endornaviridae*
■ *Hypoviridae*
■ *Narnaviridae*
▨ *Partitiviridae*
■ *Picobirnaviridae*
▨ *Reoviridae*
▨ *Totiviridae*
■ *Virgaviridae*
□ viruses
▨ unknown

[Figure 9A]
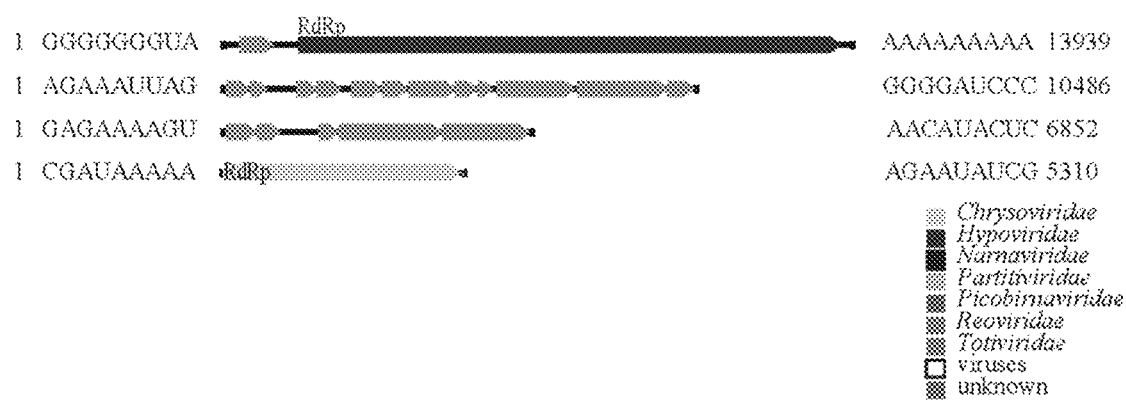

[Figure 9B]
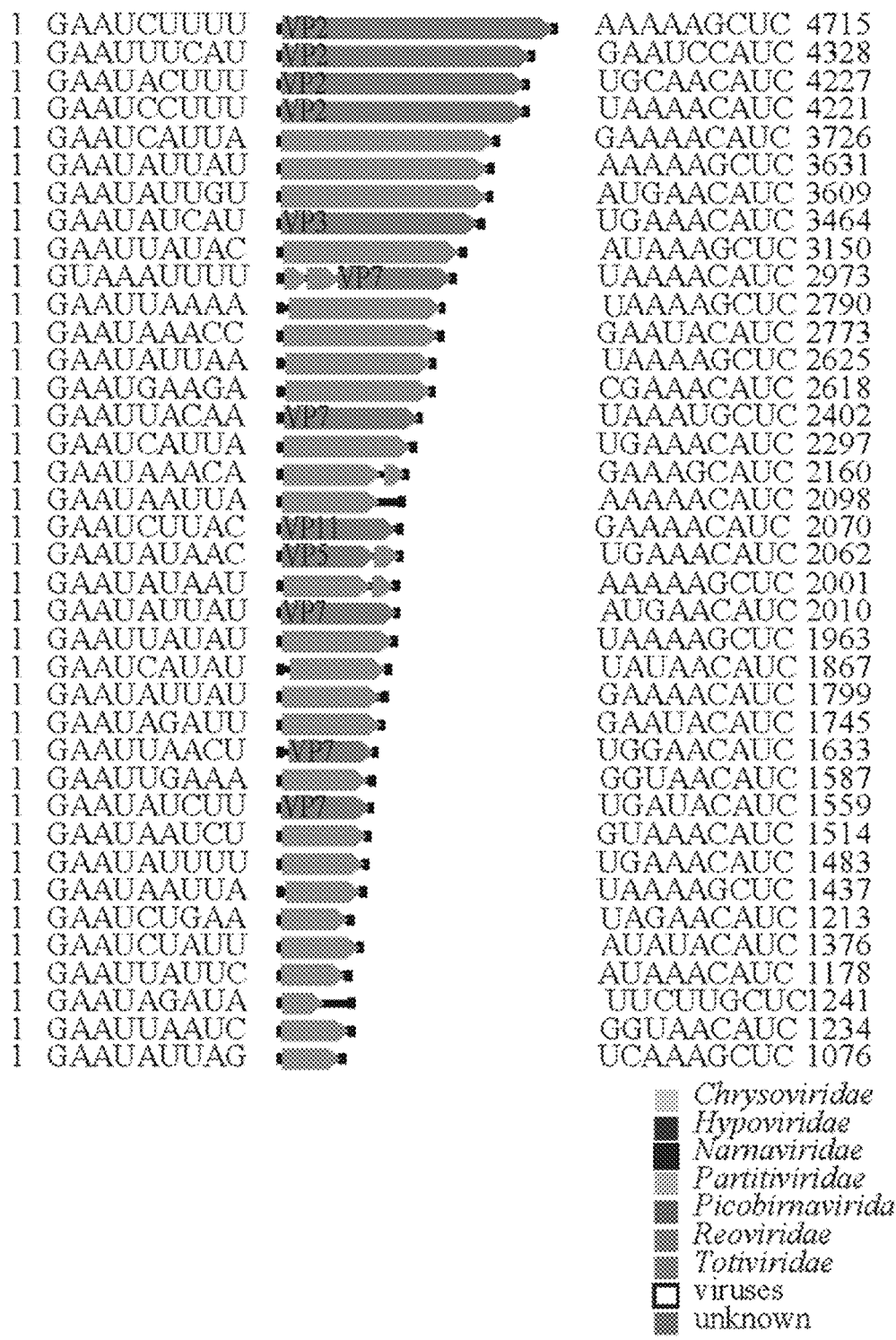

[Figure 9C]

| | | |
|---|---|---|
| 1 GAAUAAGUA | VP11 | GAGAACAUC 1069 |
| 1 GAAUAAUUU | VP11 | UAAAAGCUC 962 |
| 1 GAAUAUUUU | | UGAAACAUC 988 |
| 1 GAAUAUUAU | VP11 | UGAAACAUC 965 |
| 1 GAAUUAUUA | | AUAAACAUC 972 |
| 1 GAAUUAAAC | | GAAUACAUC 932 |
| 1 GAAUAAUUC | | GAAAACAUC 924 |
| 1 GAAUAUUGA | | UGUAACAUC 910 |
| 1 GAAUAUUGU | | AAAAACAUC 780 |
| 1 AGUGCUUAC | RdRp | CAACGCACU 2637 |
| 1 GGGCUUGUC | RdRp | CACAAGCCC 2453 |
| 1 GGGCGAAGA | RdRp | ACCACGUCC 2424 |
| 1 GGGGAUGAC | RdRp | GUCAUCCCC 2423 |
| 1 GGGGAAGAC | RdRp | GUCUACCCC 2277 |
| 1 GGGGUUGAC | RdRp | UUCAACCCC 2258 |
| 1 GGGGUUGAA | RdRp | UCCAACCCC 2236 |
| 1 GGGGUUGUU | RdRp | GUCAACCCC 2231 |
| 1 GGGGAAGAG | RdRp | GUUAACCCC 2196 |
| 1 GGGGUCGUA | RdRp | UAUGACCCC 2156 |

*Chrysoviridae*
*Hypoviridae*
*Narnaviridae*
*Partitiviridae*
*Picobirnaviridae*
*Reoviridae*
*Totiviridae*
viruses
unknown

[Figure 9D]

| | | |
|---|---|---|
| 1 AAAAAAAAA | | CAGAGCCCC 3656 |
| 1 GUAAUAAAU | | AUGACUCUC 3668 |
| 1 GGAAUAAAA | | CCAAGGACC 3643 |
| 1 GGAAAAAUU | | CCUAGGCCC 3621 |
| 1 GUAAAACUU | | UGACUCCUC 3584 |
| 1 GUAAAUUUU | | CUCCCCCCC 3554 |
| 1 GUAAAAUUU | | UUUCCUCUC 3520 |
| 1 GUAAAUAAA | | CACCCCCCC 3480 |
| 1 GGAAAAUAA | | UAUGAGUCC 3434 |
| 1 GUAAUGAAA | | UCACUGCAC 5176 |
| 1 GUAAUGAAA | | UGUGUCCUC 3246 |
| 1 GUAAUUUAU | | AAUCACCCC 1809 |
| 1 GUAAUUACC | | AGGUGUUUU 1722 |
| 1 GUAAAUAAC | | ACGUCACCC 2199 |
| 1 GUAAAGAAA | | GUUAACCCC 2006 |
| 1 GUAAAAUAA | | CGCGCCCCC 1762 |
| 1 GUUUAAAAA | | UCCUCCCCC 1836 |
| 1 GUUUAAAAU | | CAUGGCCAC 1688 |
| 1 GUUUUAAAU | | UAUCUUCCC 1934 |
| 1 GUUUUAAAU | | AUAACUCCU 1926 |
| 1 GUUUUAAAA | | CCAUCCCCC 1758 |
| 1 GUUUUAAAA | | CUCCACCUC 1746 |
| 1 AGAUAAAUA | | GCCCUCCU 2009 |
| 1 GUUUAAAAA | | UUGGAAUUU 1671 |
| 1 UUAUAAACA | | UCGGGUCCU 1651 |
| 1 UGACAAAAU | | CCAUCAGCA 4904 |
| 1 GAAACAUGA | | AAUGUUUUU 4509 |
| 1 GAAAAAGAA | | AUUUUUUU 2500 |
| 1 GAAAAAGAA | | ACAUUUUUU 775 |
| 1 ACAAUACAU | | UAGUUACUC 1596 |
| 1 ACAAUAUCU | | GGUAUAGCU 1372 |

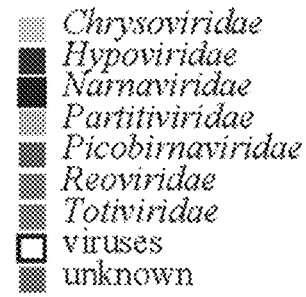

Chrysoviridae
Hypoviridae
Narnaviridae
Partitiviridae
Picobirnaviridae
Reoviridae
Totiviridae
viruses
unknown

[Figure 9E]

| | | |
|---|---|---|
| 1 GUAGCCAUU | | GGCAGUCUC 4674 |
| 1 UGGAAAAAU | | CCCCCGCCC 3644 |
| 1 ACUGGACUC | | GCCACAUCC 3021 |
| 1 GGGAAUUUA | | CUGGUACCC 1829 |
| 1 GGGAAAAGC | | UUAGCACCC 1555 |
| 1 GGGAAAAGA | | CGUACACCC 1451 |
| 1 GGAUUAUUG | | AAACAUACC 2142 |
| 1 GGAUUUAUU | | UUGACUACC 1969 |
| 1 GGAUUUUUG | | UAAAAUACC 1536 |
| 1 GGAUUUGAA | | AACAAUACC 955 |
| 1 GGGUAAGAU | | UUGCCACCC 3910 |
| 1 GGGUAAGAA | | CUUCCACCC 3024 |
| 1 ACACUAAGG | | UUUAGACCC 5423 |
| 1 ACAAUCGAA | | UUCUUACCU 194 |
| 1 UAAAACCUG | | AACAAUACC 3398 |
| 1 GAAAUAUAU | | UCCGGCCAC 4021 |
| 1 GAAGAAGAG | | CUAAAACUC 751 |
| 1 GAAGAUCGU | | AGAAACUC 966 |
| 1 GAGUAAUUA | | CCCCAUCAC 2408 |
| 1 GAGAUAUAU | | GAUCCCACC 2091 |
| 1 GAGCUAAGA | | UUCAAUUAC 1165 |
| 1 GUAUAAAAU | | CUUCCGGUC 2092 |
| 1 GUUAAUUCA | | GUCUGACUC 1194 |
| 1 GGAAACUUU | | CUUGAUACC 1732 |
| 1 GGAGAAUGA | | GCCCCACCU 2376 |

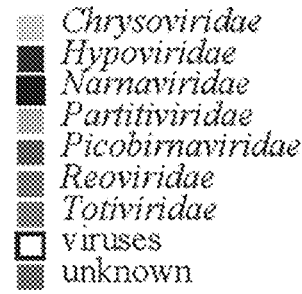

Chrysoviridae
Hypoviridae
Narnaviridae
Partitiviridae
Picobirnaviridae
Reoviridae
Totiviridae
viruses
unknown

METHOD FOR FRAGMENTING DOUBLE-STRANDED RNA AND USE OF THE SAME

TECHNICAL FIELD

The present invention relates to a method for fragmentation of a double-stranded RNA (dsRNA), and sequencing utilizing the fragmented dsRNA. The present invention can be used for determination of full-length genome of RNA viruses, and detection of known or unknown RNA viruses. The present invention is useful in the fields of life science, medical science, and so forth.

BACKGROUND ART

Detection and surveillance of viruses are important in order to understand ecological roles of viruses and control virus infection. As conventional virus detection methods, there are a method based on detection of a specific virus protein using antibody, and a method based on detection of a nucleotide sequence of a specific virus gene. For comprehensive surveillance of RNA viruses, RNA sequencing (RNA-Seq) is a common method, and has been widely used for identification or surveillance of RNA viruses. This method comprises comprehensive sequencing of nucleic acid contained in a sample, and detecting a known virus sequence or a sequence showing high homology to a known virus (expected as an unknown virus sequence).

On the other hand, DNA is a molecule bearing almost all genetic information of organisms, and DNA sequencing serves as a basic technique for analyzing genetic information. The pretreatment for DNA sequencing using a sequencer mainly consists of the following stages: (1) extraction of DNA from a sample, (2) fragmentation of DNA, (3) addition of an adapter sequence to DNA terminus, and (4) amplification of DNA. For the fragmentation of DNA, physical disruption methods using an ultrasonic device or nebulizer are used. Physical cleavage is suitable for preparation of DNA fragments for sequence analysis, since it does not depend on nucleotide sequence, and it can randomly fragment DNA without bias. In Non-patent document 1, such fragmentation using an ultrasonic device is applied to double-stranded RNA of virus. Non-patent document 1 relates to effect of fragmentation of double-stranded RNA viruses on induction of interferons by the viruses.

At the time of the fragmentation, presence or absence of phosphate group at the cleavage end is important for addition of an adapter sequence for the DNA amplification. Although Patent document 1 proposes a cleavage method for removing phosphate group from the 3' end of a nucleic acid molecule for a method of detecting enzyme, it does not aim at sequence analysis. More precisely, Patent document 1 proposes a method for detecting an enzyme contained in a sample that can add or remove a chemical moiety to or from a nucleic acid molecule, and thereby impart an ability for extension to the nucleic acid molecule so that a novel detectable nucleic acid molecule can be obtained, which comprises the step of allowing interaction of a sample to be tested for whether such an enzyme exist or not with a nucleic acid molecule, and the step of determining whether an enzyme interacts with the nucleic acid molecule by detecting a novel nucleic acid molecule that is obtainable only in the presence of the enzyme. The enzyme is preferably a phosphatase that can remove terminal phosphate group from a nucleic acid molecule, and the terminal phosphate group to be removed is phosphate group existing at the 3' end of the nucleic acid molecule.

PRIOR ART REFERENCES

Patent Document

Patent document 1: Japanese Patent Unexamined Publication (KOHYO) No. 2008-545384

Non-Patent Document

Non-patent document 1: J. Gen. Virol. (1974), 23, 191-195, Effect of fragmentation on interferon induction by double stranded virus RNA

SUMMARY OF THE INVENTION

Object to be Achieved by the Invention

In order to conduct the conventional virus detection methods, an antibody specific to a virus protein, or a nucleic acid primer specific to an objective virus gene sequence is required. Therefore, viruses to which they can be applied are limited, and unknown viruses for which information cannot be obtained beforehand cannot be detected by these methods. Further, most part of information obtained by the conventional RNA sequencing consists of those for sequences derived from non-objective cells, and sequences considered to be derived from viruses usually account for 1% or less, although the ratio may significantly change depending on sample or analysis conditions. In order to improve such bad efficiency, various improvements have been examined. However, theoretically, improvement of the efficiency complicates operations, and generates biases. Therefore, a method that enables detection of unknown virus sequences and efficient detection and surveillance of viruses is desirable, if such a method is available.

Means for Achieving the Object

On the earth, there are four types of nucleic acid species, single-stranded DNA, double-stranded DNA, single-stranded RNA (ssRNA), and double-stranded RNA (dsRNA). Among these, cells have double-stranded DNA and single-stranded RNA, and viruses have single-stranded DNA, double-stranded DNA, single-stranded RNA, and dsRNA. That is, single-stranded DNA and double-stranded RNA are nucleic acid species specific to viruses. Further, many of non-retro RNA viruses show a stage that they have dsRNA in the life cycle thereof, but cells of healthy plants, animals, or fungi hardly contain dsRNA. Therefore, by extracting and purifying only dsRNA, and conducting sequence analysis thereof, RNA viruses can be analyzed.

If dsRNA can be randomly fragmented into appropriate sizes and then amplified in advance of sequencing, it is advantageous for determination of full-length genome sequences of RNA viruses.

The present invention provides the followings.
[1] A method for determining an RNA sequence, which comprises:
the step of randomly fragmenting an objective double-stranded RNA (dsRNA) to obtain dsRNA fragments;
the step of subjecting the obtained dsRNA fragments to a reverse transcription reaction and then performing polymerase chain reaction (PCR) to obtain corresponding DNA fragments; and the step of subjecting the obtained DNA fragments to a sequence analysis operation to determine sequences of the fragments.

[2] The method according to 1, wherein the reverse transcription reaction is started from the 3' ends of the dsRNA fragments.

[3] The method according to 1 or 2, wherein the objective dsRNA is mechanically, enzymatically, or chemically fragmented.

[4] The method according to 3, wherein the objective dsRNA is mechanically fragmented by ultrasonication.

[5] The method according to any one of 1 to 4, wherein the objective dsRNA is fragmented so that phosphate groups are not left at the 3' ends of the dsRNA fragments to be obtained.

[6] The method according to 5, which further comprises the step of ligating a loop primer to the 3' ends of the dsRNA fragments to obtain primer-ligated dsRNA fragments, and wherein:

the obtained primer-ligated dsRNA fragments are subjected to a reverse transcription reaction, and then polymerase chain reaction (PCR) is performed.

[7] The method according to any one of 1 to 6, wherein the objective dsRNA is derived from an RNA virus.

[8] The method according to 7, which is for determining a full-length genome sequence of the RNA virus.

[9] The method according to 7, which is for determining a sequence of an unknown RNA virus.

[10] The method according to any one of 1 to 9, wherein the obtained dsRNA fragments have a 1000 to 4000-base length.

[11] A method for preparing DNA fragments, which comprises:

the step of randomly fragmenting an objective double-stranded RNA (dsRNA) to obtain dsRNA fragments; and the step of subjecting the obtained dsRNA fragments to a reverse transcription reaction and then performing polymerase chain reaction (PCR) to obtain corresponding DNA fragments.

[12] The method according to 11, wherein the objective dsRNA is derived from an RNA virus.

[13] A method for analyzing a virus, which comprises:

the step of separating dsRNA in a sample from DNA and single-stranded RNA to obtain purified dsRNA;

the step of randomly fragmenting the obtained purified dsRNA to obtain dsRNA fragments;

the step of subjecting the obtained dsRNA fragments to a reverse transcription reaction and then performing polymerase chain reaction (PCR) to obtain corresponding DNA fragments;

the step of subjecting the obtained DNA fragments to a sequence analysis operation to determine sequences of the fragments; and the step of analyzing presence or absence and/or characteristic of a virus in the sample on the basis of the determined sequences.

[14] The method according to 13, wherein the sample is derived from an organism or environment.

Effect of the Invention

According to the present invention, sequences of long to short dsRNA molecules having a length exceeding several tens of thousands of bases to a length of about 1000 bases can be more efficiently and uniformly determined compared with the conventional methods. In particular, sequences around both ends of an RNA genome can also be determined, which sequences are important in the sequence analysis of virus, and so forth, and hardly obtained by conventional techniques. More precisely, since the method of the present invention uses dsRNA derived from a dsRNA virus and an ssRNA virus as an object, the sequences around the 5' ends of the original RNA viruses can also be determined by determining the 3' end sequences existing in the both chains of dsRNA.

According to the present invention, a DNA fragment corresponding to an RNA virus genome including a sequence corresponding to the 3' end of a genome of the RNA virus can be prepared.

According to the present invention, RNA viruses can be efficiently searched for.

According to the present invention, full-length genome sequence of a known or unknown RNA virus can be determined.

BRIEF DESCRIPTION OF THE DRAWINGS

FIG. 1 Results of mapping at the time of using the FLDS method for determination of genome sequence of a known dsRNA virus (MoCV1-A). By using a rice plant blast fungus (*Magnaporthe oryzae*) infected by *Magnaporthe oryzae* chrysovirus 1 strain A (MoCV1-A), which is an RNA virus consisting of five dsRNAs (3554, 3250, 3074, 3043, and 2879 nt), as a sample, performance of FLDS was evaluated. By connecting the obtained sequence data, the full-length genome sequence of MoCV1-A could be reconstructed. In each genome segment, coverage tended to become higher in the end region compared with the center region.

FIG. 2 Comparison of sequence frequency in the individual virus sequences. Frequencies of reads derived from the individual virus sequences observed in RNA-seq and FLDS data were compared. As a result of plotting 37 virus sequences in which one or more reads were detected in RNA-seq data, it was found that the frequency increased 100 times or more in most viruses. It was demonstrated that, like double-stranded RNA virus, for which results are shown with ■, concentration by FLDS was also effective in 4 cases out of 5 cases for single-stranded RNA virus, for which results are shown with Δ.

FIG. 3 Comparison of RNA-seq and FLDS. (a) In order to compare magnitudes of change of coverage for 3 virus sequences from which sufficient numbers of reads were obtained also in RNA-seq, variation coefficients (percentages of standard deviation based on average) were calculated. As a result, there was observed a tendency that the variation coefficient became low in FLDS, i.e., more uniform coverage was obtained in FLDS. ■ represents results for double-stranded RNA virus, and Δ represents results for single-stranded RNA virus. (b and c) Comparison of coverages of virus reads obtained in RNA-seq and FLDS.

FIG. 4A to FIG. 4D show RNA virus candidate sequences obtained from seawater (spot: Jam). In the case of analysis using the method of the present invention, 705 full-length sequences considered to be derived from dsRNAs were obtained. More than half of the full-length sequences did not show significant sequence homology to any known RNA virus gene, and thus, in addition to novel RNA virus sequences, many completely novel RNA virus candidate sequences were obtained. The method of the present invention enables detection of presence of a completely novel RNA virus, even if the obtained contig does not show significant sequence homology to any known RNA virus gene. The same shall apply to the following drawings.

FIG. 5A to FIG. 5D show RNA virus candidate sequences obtained from seawater (spot: Jam).

FIG. 6A to 6E show RNA virus candidate sequences obtained from seawater (spot: St.73).

FIG. 7A to FIG. 7E show RNA virus candidate sequences obtained from seawater (spot: St.79).

FIG. 8A to FIG. 8D show RNA virus candidate sequences obtained from seawater (spot: St.97).

FIG. 9A to FIG. 9E show RNA virus candidate sequences obtained from seawater (spot: St.122).

MODES FOR CARRYING OUT THE INVENTION

Amino acids, peptides, nucleotide sequences, nucleic acids, and so forth indicated with abbreviations for the present invention or in this specification are indicated in accordance with the regulations of IUPAC-IUB [IUPAC-IUB Communication on Biological Nomenclature, Eur. J. Biochem., 138:9 (1984)], "Guidelines for the preparation of specifications which contain nucleotide and/or amino acid sequences" (edited by Japanese Patent Office), and expressions commonly used in this technical field, unless especially indicated.

Numerical value ranges represented as "X to Y" include the values of X and Y as the minimum and maximum values, unless especially indicated.

The present invention provides a method for determining an RNA sequence. The method of the present invention comprises the following steps:
(1) the step of randomly fragmenting an objective dsRNA to obtain dsRNA fragments;
(2) the step of subjecting the obtained dsRNA fragments to a reverse transcription reaction and then performing polymerase chain reaction (PCR) to obtain corresponding DNA fragments; and
(3) the step of subjecting the obtained DNA fragments to a sequence analysis operation to determine sequences of the DNA fragments.

[Step 1: Step of Fragmenting dsRNA]
<Purification of dsRNA Molecule>

In the step 1, an objective dsRNA is fragmented, and the objective dsRNA can be purified before or after the fragmentation. Purification can be performed by the step of extracting all nucleic acid species from a sample containing the objective dsRNA, and the step of separating nucleic acid species other than the objective dsRNA from the obtained extract. Although the separation of dsRNA from the other nucleic acid species can be performed by various methods, it can be carried out by using, for example, specific adsorption to hydroxyapatite, cellulose or the like, differential extraction using phenol, difference in susceptibility to various nucleases, or the like.

For example, the purification can be performed as follows. All the nucleic acid species are extracted from a sample containing the objective dsRNA by a conventional method, and then the obtained extract is passed through a cellulose column so that dsRNA is adsorbed on cellulose. A washing operation is performed as required, and then an elution operation is performed by using an appropriate elution buffer. A nuclease may be made to act on the obtained eluate under conditions effective for decomposing nucleic acid species other than dsRNA, as required.

The purification may be performed by the tandem chromatography method for separately obtaining 4 kinds of nucleic acid species (Syun-ichi Uray ama et. al., A New Fractionation and Recovery Method of Viral Genomes Based on Nucleic Acid Composition and Structure Using Tandem Column Chromatography, Microbes and Environments, Vol. 30 (2015) No. 2, pp. 199-203.

<Random Fragmentation>

The "random fragmentation" of nucleic acid means fragmentation in an unsystematic manner not restricted by nucleotide sequence or site thereof, unless especially indicated. The random fragmentation of an objective dsRNA can be performed mechanically, enzymatically, or chemically. Although degree of the fragmentation (size of the obtained dsRNA fragments) is not particularly limited so long as the following steps can be performed, and the object of the present invention can be attained, average size of the obtained dsRNA fragments is, for example, 150 to 5000 bp, preferably 300 to 3000 bp, more preferably 1000 to 2000 bp, irrespective of the means for the fragmentation.

(Mechanical Fragmentation)

Mechanical fragmentation can be performed by using an existing apparatus for fragmentation of DNA with appropriately applying conditions for fragmentation of DNA. Examples of mechanical fragmentation include a treatment with a sound wave (for example, ultrasonic wave), a hydrodynamic shearing treatment by passing the objective dsRNA through a thin capillary or hole, and a treatment based on atomization of dsRNA. A treatment with an ultrasonic wave is preferred, since, with such a treatment, it is comparatively easy to control average size of fragments to be uniform, and 3' ends not having phosphate group can be formed as described later.

A treatment with an ultrasonic wave can be conducted, for example, as follows. First, an objective dsRNA for fragmentation is dissolved in an appropriate buffer. Amount (or concentration) of dsRNA is not particularly limited, and it was confirmed that the present invention is also applicable to dsRNA of a comparatively small amount such as dsRNA in an amount undetectable in electrophoresis. In this treatment, the dsRNA solution is treated in an existing ultrasonicator, and thereby dsRNA is fragmented to appropriate sizes. The fragmentation can be performed in a highly controlled manner so that the sizes of the fragments should become 150 to 20000 bp. However, for the purpose of the present invention, the fragmentation is performed until sizes of fragments become, for example, 150 to 5000 bp, preferably 300 to 3000 bp, more preferably 1000 to 2000 bp. Conditions for the ultrasonication can be determined beforehand by performing a preliminary experiment. The ultrasonication can be performed with cooling in order to prevent temperature elevation, if needed. The sizes of fragmented dsRNA can be confirmed after the fragmentation treatment by using such as a means as electrophoresis, if needed. The obtained dsRNA fragments are concentrated by using such a means as ethanol precipitation, as required, and then dissolved again in an appropriate solvent. Concentration of the obtained dsRNA fragment solution is confirmed, and adjusted to an appropriate concentration, as required.

(Enzymatic Fragmentation)

Enzymatic fragmentation referred to in the present invention means a method enabling random fragmentation of dsRNA to objective sizes without any bias, and without depending on nucleotide sequence. The enzymatic fragmentation is a preferred method, since it does not require such a special apparatus as ultrasonicator. As for enzymatic cleavage, it is considered that such existing enzymes as those of RNase III type (for example, Dicer siRNA generation kit from Amsbio LLC, and ColdShock-DICER siRNA cocktail kit from TaKaRa Bio Inc., Japan), and RNase V1 type ("RNase V1 preferentially cleaves phosphodiester bonds 3' of double-stranded RNA", Kertesz, Michael, et al., "Genome-wide measurement of RNA secondary structure in yeast", Nature, 467.7311 (2010): 103-107) can randomly cleave dsRNA, and can be used for the present invention. When a dsRNA fragment obtained by the enzymatic fragmentation has a cohesive end, it may be blunt-ended, as required. Cleavage products obtained with RNase III have hydroxy groups at the 3' ends (Meister, Gunter, and Thomas Tuschl, "Mechanisms of gene silencing by double-stranded RNA", Nature, 431.7006 (2004): 343-349).

The enzymatic fragmentation can be performed, for example, as follows. DsRNA dissolved in an appropriate solvent is prepared, a prepared enzyme mix is added to the solution, and they are sufficiently mixed. Then, the reaction is started at a temperature effective for the fragmentation (for example, 30 to 45° C.). Reaction time may be 15 to 25 minutes, when, for example, the incubation is performed at 37° C., and it is desired to obtain fragments of 100 to 1000 bp. By extending the reaction time, dsRNA fragments of smaller sizes can be obtained, and by shortening the reaction time, dsRNA fragments of larger sizes can be obtained. It may be preferable to extend the reaction time in such a case as where amount of dsRNA used for the reaction is small. The reaction can usually be terminated by adding EDTA. After the fragmentation treatment, sizes of fragmented dsRNA can be confirmed by using such a means as electrophoresis, as required.

(Chemical Fragmentation)

Chemical fragmentation of DNA can be carried out with an existing means. Examples of the existing means include catalytic hydrolysis with an acid or alkali, hydrolysis with metal ion or complex, hydroxyl radical treatment, and radiation treatment. Examples of the chemical fragmentation also include fragmentation with heat. Heat fragmentation is performed at, for example, about 40° C. or higher. Those skilled in the art can understand that parameters other than temperature such as pH and/or salt concentration affect the cleavage, and can design various conditions. For example, as for conditions of the heat fragmentation, it may be performed at 95° C. (in a temperature range of about 80 to 100° C.) in a low salt concentration buffer (L-TE buffer) at a neutral pH (pH 6.0 to 9.0).

(Fragments not Having Phosphate Group at 3' End)

In a preferred embodiment, the fragmentation is performed with a means that does not leave phosphate group at the 3' end. This is because the 3' end not having phosphate group, i.e., 3'-hydroxyl group, can be ligated with a nucleic acid having 5'-phosphate group through a phosphodiester bond using a common RNA ligase (refer to T4 RNA ligase from TaKaRa Bio Inc., Japan, T4 RNA ligase from Promega Corp., USA), and therefore it can be easily ligated with the primers mentioned later. Common RNA ligases do not catalyze any reaction of combinations other than the combination of 3'-hydroxyl group and 5'-phosphate group, for example, combinations of 3'-phosphate group and 5'-hydroxyl group, 3'-hydroxyl group and 5'-hydroxyl group, 3'-dideoxynucleotide and 5'-phosphate group, 3'-hydroxyl group and 5'-triphosphate, and so forth, and do not ligate them.

The dsRNA fragments obtained by the step 1 are then used in the step 2.

[Step 2: Reverse Transcription and PCR]

<Reverse Transcription from 3' End>

In the step 2, the dsRNA fragments obtained in the step 1 are subjected to a reverse transcription reaction, and then DNA fragments corresponding to the dsRNA fragments obtained in the step 1 are obtained by PCR. More precisely, this step includes denaturation of dsRNA (single-stranding), reverse transcription using a primer, decomposition of RNA chain, and DNA amplification using DNA polymerase.

The primer used for the reverse transcription reaction is not particularly limited, so long as there is chosen a primer that can serve as an origin of reverse transcription from a template RNA under enzymatic reaction conditions used, but it is preferable to use a primer that can start the reverse transcription from the 3' end of the template RNA. This is because, with such a primer, a reverse transcription product including RNA 3' end sequence can be obtained, which sequence is important in analysis of virus etc., and is difficult to be obtained by conventional techniques. Examples of the primer that can start reverse transcription from the 3' end include a loop primer, which is used by being added to the 3' end of template RNA, an oligo dT primer, which is used with addition of a poly(A) nucleotide to the 3' end of the template RNA, a primer that is used with addition of d(G), d(T) or d(C) with terminal deoxynucleotide transferase, and corresponds to d(G), d(T) or d(C), and a primer that is used with addition of a simple single-stranded DNA adapter to the 3' end of the template RNA, and corresponds to the adapter. In a preferred embodiment, a loop primer is used. Those skilled in the art can perform addition of a primer or specific sequence to the 3' end of the template RNA by an arbitrary known method.

Primers are generally designed in consideration of four of factors, Tm value, end stability of primer region, GC content, and secondary structure. Further, primers are designed so that they do not have complementary 3' end sequences so that generation of primer dimmers is prevented. The same shall apply to the primers used in the present invention. In the present invention, existing primers may also be used.

When a loop primer is used, it can be designed so that a portion that forms a loop has a 20 to 80-base length, and it may be extended up to 100 or 120-base length, as required. The total length is, for example, 40 to 200-base length, preferably 50 to 100-base length. In the case of a primer used for a poly A sequence or adapter, it preferably has a length of 6-base length or longer, more preferably 9-base length or longer, in order to realize specific annealing. From the viewpoint of ease of DNA synthesis, the length is preferably 100-base length or shorter, more preferably 30-base length or shorter.

In the following descriptions, the present invention may be explained with reference to an example using a loop primer. Those skilled in the art can apply such explanations to a case using a primer of another type, and understand modifications required for such a case. In particular, a method for determining a sequence of dsRNA including random fragmentation of dsRNA and use of a loop primer may be called FLDS (fragmented and loop primer ligated dsRNA sequencing).

Addition of a loop primer, or addition of a poly(A) nucleotide or single-stranded DNA adapter is usually performed for dsRNA, and then a reaction for denaturation (single-stranding) of dsRNA is performed. The conditions for the denaturation of dsRNA can be appropriately determined by those skilled in the art. If dsRNA is fragmented into fragments of about several hundreds to 5000 bp, denaturation thereof can usually be carried out by a treatment at 90 to 98° C. for several seconds to several minutes, and following quenching.

The reverse transcription reaction (synthesis of cDNA chain) is performed by using an added loop primer or combination of an added sequence and a primer. The enzyme to be used is not particularly limited so long as an enzyme having an activity for DNA synthesis using RNA as the template is chosen, and examples include, for example, reverse transcriptases of various origins such as avian myeloblastosis virus-derived reverse transcriptase (AMV RTase), Molony murine leukemia virus-derived reverse transcriptase (MMLV RTase), and Rous-associated virus 2 reverse transcriptase (RAV-2 RTase). In addition, a DNA polymerase also having reverse transcription activity can be used, either. For the purpose of the present invention, an enzyme showing a reverse transcription activity at high temperature is preferred, and for example, *Thermus* bacterium-derived DNA polymerase such as Tth (*Thermus thermophilus*) DNA polymerase, thermophilic *Bacillus* bacterium-derived DNA polymerases, and so forth can be used. Although there is any particular limitation, a thermophilic *Bacillus* bacterium-derived DNA polymerase is preferred, and for example, Bst DNA polymerase (derived from *Bacillus stearothermophilus*), and Bca DNA polymerase (derived from *Bacillus caldotenax*) are more preferred. Both a naturally occurring enzyme and mutant enzyme having a reverse transcriptase activity can be used so long as they have the objective activity.

Conditions for the reverse transcription reaction can be appropriately determined by those skilled in the art depending on enzyme to be used. When RNA having a length of about several hundreds to 5000 bp is used as the template, the reverse transcription reaction can be carried out, for example, at 30 to 50° C. for several tens of minutes to several hours, and then with a treatment at 60 to 80° C. for several minutes to several tens of minutes, the enzyme can be inactivated. By the reverse transcription reaction, RNA-DNA hybrid is formed.

The RNA chain of the obtained RNA-DNA hybrid may be decomposed by a chemical method or with an appropriate enzyme, or the like. When it is decomposed by a chemical method, for example, by making the solution alkaline, and then heating the solution, only RNA can be decomposed. When an enzyme is used, ribonuclease H (RNAse H) is typically used. This enzyme is a nonspecific endonuclease, and catalyzes cleavage of RNA by hydrolysis. RNAse H produces a 5' end-phosphorylated product. Conditions for the decomposition of RNA can be appropriately determined by those skilled in the art depending on the enzyme to be used. For example, the decomposition can be carried out at 30 to 50° C. for several tens of minutes to several hours, and then with a treatment at 60 to 80° C. for several minutes to several tens of minutes, the enzyme can be inactivated. After the reverse transcription reaction or RNAse H treatment, an operation for removing excessive template RNA chain may be performed. A single-stranded DNA can be obtained by decomposition of the RNA chain of the RNA-DNA hybrid.

The effect of the decomposition of RNA chain of the RNA-DNA hybrid may be attained by the denaturation performed as the first stage of PCR. Therefore, the reaction time of the denaturation as the first stage of the following PCR may be made relatively longer, in consideration of the rigidity of the hybrid of DNA and RNA, instead of performing the reaction for decomposing RNA using RNAse H.

The single-stranded DNA obtained by the decomposition of the RNA chain of the RNA-DNA hybrid may be subjected to desalting and concentration steps as required. The single-stranded DNA can be annealed by once heating it to a high temperature, and then gradually lowering the temperature, and after a treatment with a DNA polymerase as the case may be, a double-stranded cDNA can be obtained. The double-stranded cDNA is amplified by the following PCR.

<PCR>
PCR used in the present invention may be any of various types of PCR used for the same purpose. PCR can be usually carried out by the steps of denaturation of template double-stranded DNA into single-strand DNA, annealing of primers, and synthesis of a complementary strand from the primers (extension). Conditions for PCR used in the present invention can be appropriately determined by those skilled in the art, and it can be performed, for example, by denaturation at 80 to 98° C. for several minutes, and 5 to 50 cycles of a treatment for annealing and extension reaction with a polymerase at 65 to 75° C. for several minutes. After this treatment, a treatment for removing small molecules of cDNA and primer dimers may be performed. The double-stranded DNA fragments amplified by PCR, which correspond to the dsRNA fragments, are subjected to the following sequencing step. The PCR product may be subjected to the sequencing step after it is purified by subjecting it to an appropriate purification method, for example, a treatment with a molecular sieve for purification of PCR product such as Microcon-100.

[Step 3: Step of Determining Sequence]
<Acquisition of Sequence Data>

The sequencing step includes acquisition of base sequence data from the DNA fragments as the PCR product, and analysis of full-length sequence by processing of those sequence data.

For the acquisition of base sequence data from DNA fragments, an existing sequencer can be used. A commercial sequencing kit may also be used. In a preferred embodiment, a means for performing sequence reading with synthesizing a complementary strand DNA (Sequencing By Synthesis (SBS), Bentley et al. (2008) Accurate whole human genome sequencing using reversible terminator chemistry, Nature, 456:53-59), which is called next generation sequencer, is used for determining base sequence.

The sequencing step by the next generation sequencer usually comprises the steps of sample preparation, cluster formation, sequencing, and data analysis. The sample preparation is a step of preparing a library for analyzing sequences by a sequencer, and usually includes fragmentation into DNAs of 200 to 600 bp, and addition of an adapter sequence and a primer sequence, as well as addition of an index for identifying a sample from which DNA is derived, as required. For the sample preparation, various kinds of kits corresponding to sequencers are marketed, and can also be used for the present invention according to the sequencer to be used. The cluster formation is an amplification step performed for the purpose of increasing amount of the prepared DNA library to a sufficient amount with which DNA can be detected at the time of sequencing. The cluster formation is typically carried out on a glass substrate called flow cell. Sequencing according to the SBS method consists of a step of reading nucleotide sequence-dependent fluorescence. The SBS method is a modification of the Sanger method, and is performed with four kinds of nucleotides that are labeled with fluorescence, and terminate further chain extension with a blocking group at the 3' end. The four kinds of nucleotides are distinguished on the basis of type of fluorescence. The data analysis is a step of synthesizing the data to obtain a nucleotide sequence.

Information for sequencing by a next generation sequencer is available from, for example, Illumina Technologies (www.illumina.com), and WO2004/018497, WO2004/018493, WO2004/050915, WO2004/076692, WO2005/021786, WO2005/047301, WO2005/065814, WO2005/068656, WO2005/068089, and WO2005/078130 can be referred to.

With a next generation sequencer, at least 1000 reads (read fragments), 10,000 reads, 100,000 reads, 500,000 reads, or 1,000,000 reads can be generated per one run. Further, per one read, sequence data of about 30-base length, about 40-base length, about 50-base length, about 60-base length, about 70-base length, about 80-base length, about 90-base length, about 100-base length, about 110-base length, about 120-base length, about 150-base length, about 200-base length, about 250-base length, about 300-base length, about 350-base length, about 400-base length, about 450-base length, about 500-base length, about 550-base length, about 600-base length, about 650-base length, about 700-base length, or further longer length can be generated.

<Sequence Data Processing>

Sequence data processing is performed by using sequence data of DNA fragments having a length of several hundreds of nucleotides in order to reconstruct a longer gene or genome, preferably gene or genome of full-length. For the sequence data processing, various kinds of programs have been developed, and they can also be used for the present invention. The sequence data processing usually includes the steps of importing data from a sequencer, trimming of excessive sequence data such as those of adapter and primer, removing low quality sequence region, and assembling read sequence data. The methods for the assembling of sequences can be roughly classified into two types of methods, de novo-assembling (assembling read sequences to reconstruct an unknown genome sequence), and mapping (mapping reads on an existing genome sequence as a reference sequence), and both can be preferably used for the present invention.

Effects, Advantages, Etc.

According to the aforementioned method for determining an RNA sequence of the present invention, sequences of dsRNA molecules having a long length exceeding several tens of thousands of nucleotides to a short length of about 1000 nucleotides can be determined efficiently and more uniformly compared with conventional techniques. In particular, sequences around both ends of RNA genome can also be determined, which sequences are important in the sequence analysis of viruses etc., and are difficult to be determined with conventional technique. More precisely, since sequences of dsRNA derived from a dsRNA virus and an ssRNA virus can be determined by the method of the present invention, by determining the 3' end sequences existing in both chains of dsRNA sequence, sequences around the 5' ends of the original RNA viruses can also be determined. End sequences of virus genomes include important information, and it is advantageous that such information can be surely obtained.

In many cases, common end sequences are conserved in segments of multipartite genome of virus. When one segment of multipartite genome is presumed to be a virus-like sequence in identity search, but other segments do not show homology to any known virus sequence, if end sequences of them are common, it can be presumed that these segments are derived from the same virus. That is, even unknown segments not showing identity to a known virus sequence may also be identified as a virus according to the present invention.

Application, Other Embodiments, Etc. of the Present Invention

<Analysis of Virus>

The method of the present invention can be used for determining full-length genome sequence of an RNA virus. It can also be used for determining sequence of an unknown RNA virus.

Sequence of dsRNA can be determined by the method of the present invention. Life cycles of many RNA viruses include a period of having dsRNA, but dsRNA is hardly contained in cells of healthy plants, animals, or fungi. Therefore, presence of dsRNA represents presence of a virus, and a determined sequence of dsRNA can be used for virus analysis. The analysis of virus comprises detection of virus, characterization of virus by sequence comparison with known viruses, and so forth.

The method for analyzing virus of the present invention comprises at least the following steps:

the step of separating dsRNA in a sample from DNA and single-stranded RNA (ssRNA) to obtain purified dsRNA;

the step of randomly fragmenting the obtained purified dsRNA to obtain dsRNA fragments;

the step of subjecting the obtained dsRNA fragments to a reverse transcription reaction and performing polymerase chain reaction (RT-PCR) to obtain corresponding DNA fragments;

the step of subjecting the obtained DNA fragments to a sequence analysis operation to determine sequences of the DNA fragments; and the step of analyzing presence or absence, and/or characteristics of a virus in the sample on the basis of the determined sequences.

The explanations described above for the method for determining RNA sequence are also applied to the method for analyzing virus.

<Novel RNA Virus and Full-Length Sequence Thereof>

The present invention also provides 31 novel polynucleotides (full-length sequences) found by the method of the present invention, 22 virus genomes constituted with any of the foregoing polynucleotides, and viruses containing the virus genomes. The present invention also provides 718 novel polynucleotides derived from viruses and found by the method of the present invention, virus genomes constituted with any of the foregoing polynucleotides, and viruses containing the virus genomes. Specifically, the present invention provides the followings.

A polynucleotide defined in (A), (B), or (C) mentioned below, a virus genome constituted with the polynucleotide, or a virus containing the virus genome:

(A) a polynucleotide consisting of a nucleotide sequence of any of SEQ ID NOS: 1 to 31, and 34 to 751;

(B) a polynucleotide that hybridizes with a polynucleotide consisting of a nucleotide sequence complementary to the polynucleotide of (A) under stringent conditions, and can constitute a genome of a mutant virus that is taxonomically identical to a virus containing a virus genome constituted by the polynucleotides of (A);

(C) a polynucleotide that shows high identity to the polynucleotide of (A), and can constitute a genome of a mutant virus that is taxonomically identical to a virus containing a virus genome constituted by the polynucleotides of (A). The type of sequence indicated in <212> of Sequence Listing, DNA, can be read as RNA, and t in the sequences can be read as u.

Names of viruses, nucleotide lengths, and classifications of the polynucleotides of SEQ ID NOS: 1 to 31 are summarized in the following table. In the table, SEQ ID NOS: 1, 2, 23, 27, and 29 are those of viruses of which genome structures are novel, or viruses of the same family as that of animal pathogenic viruses.

TABLE 1

| Virus | Abbreviation | Nucl. Length | Taxonomy | SEQ ID NO. |
|---|---|---|---|---|
| Diatom colony associated dsRNA virus 1 | DCADSRV-1 segment 1 | 1734 | Viruses: dsRNA viruses: Picobimaviridae: unclassified | 1 |
|  | DCADSRV-1 segment 2 | 1562 |  | 2 |
| Diatom colony associated dsRNA virus 2 | DCADSRV-2 | 4026 | Viruses: dsRNA viruses | 3 |
| Diatom colony associated dsRNA virus 3 | DCADSRV-3 | 4911 | Viruses: dsRNA viruses: Totiviridae | 4 |
| Diatom colony associated dsRNA virus 4 genome type A | DCADSRV-4 genome type A | 4982 | Viruses: dsRNA viruses: Totiviridae | 5 |
| Diatom colony associated dsRNA virus 4 genome type B | DCADSRV-4 genome type B | 4979 | Viruses: dsRNA viruses: Totiviridae | 6 |
| Diatom colony associated dsRNA virus 5 | DCADSRV-5 | 5252 | Viruses: dsRNA viruses: Totiviridae | 7 |
| Diatom colony associated dsRNA virus 6 | DCADSRV-6 | 4939 | Viruses: dsRNA viruses: Totiviridae | 8 |
| Diatom colony associated dsRNA virus 7 | DCADSRV-7 | 5327 | Viruses: dsRNA viruses: Totiviridae | 9 |
| Diatom colony associated dsRNA virus 8 | DCADSRV-8 | 4660 | Viruses: dsRNA viruses: Totiviridae | 10 |
| Diatom colony associated dsRNA virus 9 genome type A | DCADSRV-9 genome type A | 4844 | Viruses: dsRNA viruses: Totiviridae | 11 |
| Diatom colony associated dsRNA virus 9 genome type B | DCADSRV-9 genome type B | 4845 | Viruses: dsRNA viruses: Totiviridae | 12 |
| Diatom colony associated dsRNA virus 10 | DCADSRV-10 | 5082 | Viruses: dsRNA viruses: Totiviridae | 13 |
| Diatom colony associated dsRNA virus 11 | DCADSRV-11 | 5160 | Viruses: dsRNA viruses: Totiviridae | 14 |
| Diatom colony associated dsRNA virus 12 | DCADSRV-12 | 5941 | Viruses: dsRNA viruses: Totiviridae | 15 |
| Diatom colony associated dsRNA virus 13 | DCADSRV-13 | 4671 | Viruses: dsRNA viruses: Totiviridae | 16 |
| Diatom colony associated dsRNA virus 14 | DCADSRV-14 segment 1 | 1576 | Viruses: dsRNA viruses: Partitiviridae: unclassified | 17 |
|  | DCADSRV-14 segment 2 | 1490 |  | 18 |
| Diatom colony associated dsRNA virus 15 | DCADSRV-15 | 12172 | Viruses: dsRNA viruses: Endornaviridae: unclassified | 19 |
| Diatom colony associated dsRNA virus 16 | DCADSRV-16 | 6635 | Viruses: unclassified viruses | 20 |
| Diatom colony associated dsRNA virus 17 genome type A | DCADSRV-17 genome type A | 5907 | Viruses: dsRNA viruses | 21 |
| Diatom colony associated dsRNA virus 17 genome type B | DCADSRV-17 genome type B | 5909 | Viruses: dsRNA viruses | 22 |
| Diatom colony associated ssRNA virus 1 | DCASSRV-1 | 11413 | Viruses: ssRNA viruses: ssRNA positive-strand viruses, no DNA stage: Flaviviridae | 23 |
| Diatom colony associated ssRNA virus 2 | DCASSRV-2 | 4586 | Viruses: ssRNA viruses: ssRNA positive-strand viuses, no DNA stage: Narnaviridae: unclassified Narnaviridae | 24 |
| Diatom colony associated virus-Like RNA Segment 1 | virus-like dsRNA-1 | 4567 | Viruses: dsRNA viruses | 25 |
| Diatom colony associated virus-Like RNA Segment 2 | virus-like dsRNA-2 | 4786 | Viruses: dsRNA viruses | 26 |
| Diatom colony associated virus-Like RNA Segment 3 | virus-like dsRNA-3 | 3458 | Viruses: dsRNA viruses: Totiviridae | 27 |
| Diatom colony associated virus-Like RNA Segment 4 | virus-like dsRNA-4 | 3190 | Viruses: dsRNA viruses: Totiviridae | 28 |
| Diatom colony associated virus-Like RNA Segment 5 | virus-like dsRNA-5 | 3262 | Viruses: dsRNA viruses: Totiviridae | 29 |
| Diatom colony associated virus-Like RNA Segment 6 | virus-like dsRNA-6 | 3325 | Viruses: dsRNA viruses: Totiviridae | 30 |
| Diatom colony associated virus-Like RNA Segment 7 | virus-like dsRNA-7 | 1986 | Viruses: dsRNA viruses: Partitiviridae: unclassified Partitiviridae | 31 |

As for the expression "hybridize under stringent conditions" used for polynucleotides in the present invention, hybridization conditions can be appropriately chosen for any polynucleotide depending on the polynucleotide to be obtained according to the descriptions of Molecular Cloning A Laboratory Manual, 2nd ed. (Sambrook et al., Cold Spring Harbor Laboratory Press), or Hybridization of Nucleic Acid Immobilization on Solid Supports (ANALYTICAL BIOCHEMISTRY, 138, 267-284 (1984)), unless especially indicated. For example, when it is desired to obtain DNA showing an identity of 85% or higher, there can be used conditions that hybridization is performed at 45° C. in the presence of 2×SSC solution and 50% formamide, and then the filter is washed at 60° C. with 0.1×SSC solution (1×SSC solution has a composition of 150 mM sodium chloride and 15 mM sodium citrate). When it is desired to obtain DNA showing an identity of 90% or higher, there can be used conditions that hybridization is performed at 50° C. in the presence of 2×SSC solution and 50% formamide, and then the filter is washed at 65° C. with 0.1×SSC solution.

Unless especially indicated, the term "identity" used for base sequence (also referred to as nucleotide sequence) in the present invention means percentage of number of identical nucleotides of two sequences aligned in an optimal manner. That is, the identity can be calculated in accordance with the following equation: Identity=(Number of identical nucleotides)/(Total number of nucleotides)×100, and can be calculated according to a marketed algorithm. Such an algorithm is used in the programs NBLAST and XBLAST described in Altschul et al., J. Mol. Biol., 215 (1990) 403-410. More precisely, search and analysis concerning identity of nucleotide sequence can be performed according an algorithm well known to those skilled in the art or by using a program using such an algorithm (for example, BLASTN, BLASTP, BLASTX, ClustalW). Parameters used in such a program can be appropriately determined by those skilled in the art, or default parameters of each program may also be used. Specific procedures of these analysis methods are also well known to those skilled in the art.

In this specification, the term "high" used for identity of nucleotide sequence means sequence identity of at least 70%, preferably 80% or higher, more preferably 85% or higher, still more preferably 90% or higher, further preferably 95% or higher, still further preferably 97.5% or higher, even still further preferably 99% or higher, unless especially indicated.

<Method for Preparing DNA Fragments>

The present invention also provides a method for preparing DNA fragments. This method comprises at least the following steps:

the step of randomly fragmenting an objective dsRNA to obtain dsRNA fragments; and the step of subjecting the obtained dsRNA fragments to a reverse transcription reaction and then performing polymerase chain reaction (PCR) to obtain corresponding DNA fragments.

The DNA fragments obtained by this method are

The explanations described for the aforementioned method for determining RNA sequence are also applied to the method for analyzing a virus.

<Sample>

In the present invention, a sample containing an objective dsRAN is used, and such a sample is prepared from any organism or material derived from the environment. The sample may be, for example, a virus, microorganism, plant, animal, a part thereof (for example, organ or internal organ, cell, etc.), material obtained from them (for example, extract, body fluid, excretion, etc.), a part of biosphere thereof (for example, culture broth, aqueous environment, soil, air, etc.), or the like. The organism may be in a healthy state, or disease or certain pathological state.

Specific examples of the sample include samples derived from a living body such as cell culture (for example, mammalian cell culture, bacterial culture, etc.), samples containing nucleic acid such as viroids, viruses, bacteria, molds, yeasts, plants, and animals, samples that may be contaminated with microorganisms such as viruses and bacteria (foods, biological preparations, etc.), and samples that may contain organisms such as soil, drainage, seawater, and hot spring water. The sample may be a preparation containing a nucleic acid obtained by treating any of the samples mentioned above etc. by a known method. As such a preparation, disrupted cells and samples obtained by fractionation of disrupted cells, such samples in which a nucleic acid, or a group of specific nucleic acid molecules such as mRNA is enriched, and so forth can be used for the present invention. Further, a nucleic acid such as DNA or RNA obtained by amplifying a nucleic acid contained in such samples as mentioned above by a known method, and so forth can also be preferably used.

Examples

Those skilled in the art will understand that the techniques disclosed below are mentioned for the purpose of supporting embodiments of the present invention with experiments. The technical scope of the present invention should be construed on the basis of the descriptions of the appended claims, and is not limited to the embodiments described in the following section of examples.

[Materials & Methods]

<*Magnaporthe oryzae* Chrysovirus 1 Strain A>

The rice plant blast fungus S-0412-II 1a infected with *Magnaporthe oryzae* chrysovirus 1 strain A (MoCV1-A) was inoculated in the YG liquid medium (0.5% yeast extract, 2% glucose), and cultured for two weeks at 25° C. with reciprocal shaking at 60 rpm (since this fungus is a rice plant blast fungus obtained in Vietnam, and requires certain permission for handling, the experiment was performed in the laboratory of Professor Teraoka of Tokyo University of Agriculture and Technology, who already had such a permission). As for MoCV1-A, there are related patents and patent applications (for example, EP2679675, US20110020289, etc.).

<Diatom Sample>

Colonies of a diatom were sampled from a tidal pool in Tokyo Bay (35.3405° N, 139.6396° E) in April 2014. After washing with distilled water, the colonies were stored at −80° C.

<Purification and Fragmentation of dsRNA>

DsRNA was purified as described by Okada et al. with a few modifications. Briefly, the sample was pulverized in liquid nitrogen in a mortar, and total nucleic acids were extracted. DsRNA was purified twice by using a micro-spin column (empty Bio-spin column, Bio-Rad Laboratories, Inc., Hercules, Calif., USA) filled with cellulose powder (Cellulose D, ADVANTEC, Tokyo, Japan). The experiments concerning MoCV1-A up to this stage were performed in Tokyo University of Agriculture and Technology. A solution of the eluted nucleic acid was prepared (57 mM $CH_3COONa$, 9.5 mM $MgCl_2$, 1.9 mM $ZnSO_4$, 189 mM NaCl, final concentrations), and treated with DNase I (amplification grade, Invitrogen, Carlsbad, Calif., USA) and 51 nuclease (Invitrogen) at 37° C. for 2 hours. A solution of the obtained dsRNA was prepared (90 mM $CH_3COONa$, 15 mM $MgCl_2$, 3 mM $ZnSO_4$, 300 mM NaCl, final concentrations), and dsRNA was collected by using RNeasy Mini Kit (Qiagen, Valencia, Calif.).

One-tenth volumes of 10× ShortCut buffer and 10× MnCl attached to ShortCut RNase III (NEB Japan, Tokyo, Japan) were added to the collected dsRNA solution. The solution was put into Snap-Cap microTUBEs, and dsRNA was fragmented by ultrasonication using Covaris 5220 (Woburn, Mass., USA) under the following conditions: 35 sec run, peak power 140.0 W, duty factor 2.0%, and 200 cycles/burst. Fragmented dsRNA was divided into two equal volumes, and samples containing or not containing ShotCut RNase III (NEB) were prepared, and kept at 37° C. for 40 minutes. Then, the dsRNAs were collected by using ZymoClean Gel RNA Recovery Kit (ZymoResearch, Orange, Calif.). In this experiment, dsRNA of about 100 ng was used, and the fragmentation was performed under conditions determined beforehand for fragmentation into fragments of about 1500 bp.

<cDNA Synthesis and Amplification>

The PC3-T7 loop primer (5'-pGGA TCC CGG GAA TTC GGT AAT ACG ACT CAC TAT ATT TTT ATA GTG AGT CGT ATT A-OH-3', SEQ ID NO: 752) was ligated to the fragmented dsRNA according to the method described by Potgieter et al. ("Improved strategies for sequence-independent amplification and sequencing of viral double-stranded RNA genomes", Journal of General Virology 90.6 (2009): 1423-1432). After the ligation, dsRNA was concentrated and purified by using MinElute Gel Extraction Kit (Qiagen). After the addition of DMSO at a final concentration of 15% (v/v), dsRNA was heat-treated at 95° C. for 3 minutes, and quenched on ice. The RNA was reverse transcribed from the ligated loop primer region used as the primer by using Superscript III First-Strand Synthesis System (Invitrogen). After RNA of the DNA-RNA hybrid was removed, the corresponding DNA was concentrated and purified by using MinElute PCR Cleanup Kit (Qiagen). The obtained DNA was annealed to DNA having a complementary sequence by gradually lowering the temperature from 95 to 50° C. The KOD-plus Neo (Toyobo, Osaka, Japan) PCR solution was heat-activated, then the annealed DNA was added to the solution, and the resulting mixture was maintained at 68° C. to obtain completely double-stranded DNA. Thereafter, DNA was amplified by PCR using PC2 primer (5'-CCGAATTCCCGGGATCC-3', SEQ ID NO: 753) under the following conditions: 96° C. for 2 minutes; and 18 cycles of 98° C. for 10 seconds, and 68° C. for 2 minutes. Small molecules such as primer contained in the amplification product were removed by using SPRIselect Reagent Kit (Beckman Coulter, Brea, Calif., USA).

<Total RNA Extraction, cDNA Synthesis, and Library Construction>

Total RNA was extracted from a diatom colony using TRIzol Plus RNA Purification Kit (Invitrogen). The obtained RNA fraction was treated with DNase I (Takara, Otsu, Japan) to remove remaining DNA. DsDNA having a sequence corresponding to RNA was synthesized with random primers (9-mer) by using PrimeScript Double Strand cDNA Synthesis Kit (Takara). The resultant dsDNA was quantified by using Qubit dsDNA HS Kit.

<Sequence Analysis Using Illumina> cDNA was fragmented by ultrasonication using Covaris 5220 (Woburn, Mass., USA) in Snap-Cap microTUBEs (4° C., 55 seconds, peak power 175.0 W, duty factor 5.0%, and cycles/burst 200 cycles). An Illumina sequence library was constructed by using KAPA Hyper Prep Kit Illumina Platforms (Kapa Biosystems, Woburn, Mass., USA) according to the manufacturer's protocol. Quantity of the library was evaluated by using KAPA Library Quantification Kit (Kapa Biosystems). Paired-end sequence analysis of the obtained library was performed by using Illumina MiSeq Platforms (San Diego, Calif., USA).

<Sequence Data Processing>

Raw sequences obtained by the sequence analysis were processed by using CLC Genomics Workbench (CLC Bio, Aarhus, Denmark). Low quality sequences as well as sequence adaptor, PC2 primer sequences, PhiX sequences derived from control libraries, and experimentally contaminated sequences (fewer than 0.05%) were removed. The remaining sequences were assembled de novo to obtain sequences. On the basis of these sequences, contigs were manually confirmed, and extended by using Tablet Viewer. Finally, among the obtained contigs, those showing average coverage of 10 or higher, sequence coverage of at least 3, and length of 1,000 bp or longer were used for the following experiments. If particularly dominant reads (more than 10 reads) were stopped at the same position, the position was recognized as a terminal end of the contig. Reasonability of this recognition was also supported by the presence of PC2 primer sequence next to the predicted terminal sequence in these sequences before the trimming, except for viruses having contigs with poly(A) tail of various nucleotide lengths. Contigs showing 70 to 90% nucleotide identity with other contig found in comparison of contigs were considered as different genome types of the same virus spices. Contigs showing 90% or higher nucleotide identity were assigned as sequences of the same genome type, and only major contig sequence was used for further analysis. Assembled sequences were handled with Genetyx-MAC software version 17.0.0 (Genetyx Corp., Tokyo, Japan). Small subunit rRNA sequences were obtained by using EMIRGE.

<Phylogenic Analysis>

On the basis of the amino acid sequence of the RNA-dependent RNA polymerase (RdRp) commonly conserved in RNA viruses, phylogenic relationship of the viruses was estimated. Multiple alignments of the deduced amino acid sequences of the de novo assembled contigs and RdRp sequences of known RNA viruses were performed by using ClustalX 2.0 and MEGA5 software. Phylogenetic analyses based on the multiple alignments were conducted by using MrBayes 3.2.3 with the model of amino acid substitution, RtREV+I+G+F.

[Performance Assessment of FLDS Using Known Virus]

By using the rice plant blast fungus (*Magnaporthe oryzae*) infected with *Magnaporthe oryzae* chrysovirus 1 strain A (MoCV1-A) as a sample, performance of FLDS was evaluated. MoCV1-A is an RNA virus consisting of five dsRNAs (3554, 3250, 3074, 3043, and 2879 nt).

By connecting the obtained sequence data, the full-length genome sequence of MoCV1-A could be reconstructed. The reconstructed MoCV1-A sequence was substantially identical (>99.9%) to the MoCV1-A sequence opened to the public in a database (DNA Data Bank of Japan) (AB560761 to AB560764, and AB700631). There was also observed a tendency that coverage became higher in the end region of each segment of the multipartite genome compared with center region (refer to FIG. 1).

The full-length sequence of the dsRNA molecule could be determined by FLDS. When FLDS was used, the RACE method, or the like generally used for the determination of terminal sequence of RNA molecules was not required. It was found that it can be expected to surely obtain a terminal sequence including important information by this method. Further, if it is found that terminal sequences of segments are common, it can be presumed that those segments are derived from the same virus, and therefore unknown segments not showing identity to any known virus sequence may be identified to be derived from a virus.

[Search of Environmental Sample for RNA Virus]

(1) RNA viruses contained in 1 g of a sample of colonies of a diatom were searched for. Among the sequences reconstructed from the obtained sequence data, 42 were recognized as virus sequences. Full-length sequences are obtained for 31 sequences among them, and 22 virus genomes (all are new species) were reconstructed from them (refer to Table 2). For the sequences indicated with ●, any known sequence showing homology to them was not found in databases, but they were determined to be a part of virus genome on the basis of genome terminal sequences or genome structures of closely related viruses.

TABLE 2

22 Virus genomes and 7 virus-like sequences reconstructed from 31 full-length sequences

| RNA virus spices | Description | Size (nt) | Num. of mapped reads | Average coverage | BlastX analysis |
|---|---|---|---|---|---|
| DCADSRV-1 | | 1,734 | 1,301,278 | 191,942 | — |
| • | | 1,562 | 1,717,396 | 279,580 | Fox picobiRNAvirus PicoviRNAviridae |
| DCADSRV-2 | | 4,026 | 1,337,570 | 83,876 | *Ustilaginoidea virens* nonsegmented virus 1 Not assigned |
| DCADSRV-3 | | 4,911 | 14,544 | 703 | *Ustilaginoidea virens* RNA virus 1 Totiviridae |
| DCADSRV-4 | Genome type A | 4,982 | 12,325 | 591 | *Aspergillus* mycovirus 178 Totiviridae |
| DCADSRV-4 | Genome type B | 4,979 | 1,074 | 52 | *Ustilaginoidea virens* RNA virus 1 Totiviridae |
| DCADSRV-5 | | 5,252 | 7,863 | 359 | *Aspergillus foetidus* slow virus 1 Totiviridae |
| DCADSRV-6 | | 4,939 | 2,720 | 131 | *Aspergillus* mycovirus 178 Totiviridae |
| DCADSRV-7 | | 5,327 | 1,957 | 87 | *Gremmeniella abietina* RNA virus L1 Totiviridae *Ustilaginoidea virens* RNA virus 3 Totiviridae |
| DCADSRV-8 | | 4,660 | 1,163 | 60 | *Aspergillus foetidus* slow virus 1 Totiviridae |
| DCADSRV-9 | Genome type A | 4,844 | 1,198 | 60 | *Magnaporthe oryzae* virus 2 Totiviridae |
| DCADSRV-9 | Genome type B | 4,845 | 364 | 18 | *Aspergillus foetidus* slow virus 1 Totiviridae |
| DCADSRV-10 | | 5,082 | 1,244 | 59 | *Rosellinia necatrix* victorivirus 1 Totiviridae *Ustilaginoidea virens* RNA virus 1 Totiviridae |
| DCADSRV-11 | | 5,160 | 1,173 | 55 | *Ustilaginoidea virens* RNA virus 1 Totiviridae *Ustilaginoidea virens* RNA virus 1 Totiviridae |
| DCADSRV-12 | | 5,941 | 1,219 | 49 | *Beauveria bassiana* RNA virus 1 Totiviridae |
| DCADSRV-13 | | 4,671 | 820 | 42 | *Aspergillus foetidus* slow virus 1 Totiviridae |
| DCADSRV-14 | | 1,576 | 438 | 67 | Persimmon cryptic virus Partitiviridae |
| • | | 1,490 | 274 | 43 | — |
| DCADSRV-15 | | 12,172 | 1,482 | 29 | Chalara endoRNAvirus CeEV1 EndoRNAviridae |
| DCASSRV-1 | | 11,413 | 1,011 | 21 | Border disease virus - BD31 Flaviviradae |
| DCASSRV-2 | | 4,586 | 4,153 | 224 | Tuber excavatum mitovirus NaRNAviridae |
| DCADSRV-16 | | 6,635 | 8,735 | 310 | *Rhizoctonia fumigata* mycovirus Not assigned |
| DCADSRV-17 | Genome type A | 5,907 | 5,325 | 218 | dsRNA virus environmental sample Not assigned |
| DCADSRV-17 | Genome type B | 5,909 | 1,564 | 63 | *Botrytis porri* RNA virus 1 Not assigned |
| DCAVLRS-1 | Interrupted RdRp | 4,567 | 57,802 | 3,039 | *Ustilaginoidea virens* nonsegmented virus 1 Not assigned |
| DCAVLRS-2 | Interrupted RdRp | 4,786 | 41,181 | 2,100 | *Ustilaginoidea virens* nonsegmented virus 1 Not assigned |
| DCAVLRS-3 | CP only | 3,458 | 13,140 | 876 | *Ustilaginoidea virens* RNA virus 1 Totiviridae |
| DCAVLRS-4 | RdRp only | 3,190 | 3,995 | 294 | *Magnaporthe oryzae* virus 2 Totiviridae |
| DCAVLRS-5 | CP only | 3,262 | 1,331 | 96 | *Phomopsis vexans* RNA virus Totiviridae |
| DCAVLRS-6 | RdRp only | 3,325 | 891 | 65 | *Ustilaginoidea virens* RNA virus 3 Totiviridae |
| DCAVLRS-7 | Interrupted RdRp | 1,986 | 164 | 20 | *Flammulina velutipes* browning virus Partitiviridae |

Criteria: Average coverage of 10 or higher, minimum coverage of at least 3, and terminal sequence of 10 reads or more (2-1) Then, the RNA-seq method generally used for RNA virus search and FLDS were compared. The reads obtained by the respective analyses were mapped on 42 of the reconstructed virus sequences. As a result, 98.2% of the reads were mapped in FLDS, whereas only 0.3% of the reads were mapped in RNA-seq (refer to Table 3). When virus genomes were reconstructed by using only RNA-seq data, only 6 partial sequences were obtained. No virus was detected from only the RNA-seq data.

TABLE 3

| Items of the obtained reads | | | | |
|---|---|---|---|---|
| | FLDS | | total RNA-seq | |
| | Num. of reads | rate (%) | Num. of reads | rate (%) |
| Trimmed | 4,631,738 | 100.0 | 6,979,561 | 100.0 |
| Major viral reads | 4,549,629 | 98.2 | 24,036 | 0.3 |
| Unmapped reads (include minor viral reads) | 82,109 | 1.7 | 6,955,525 | 99.6 |

(2-2) Frequencies of the reads derived from individual virus sequences and appeared in the RNA-seq and FLDS data were compared (refer to FIG. 2). Plotting of 37 virus sequences for which one or more reads were detected in RNA-seq data showed that the frequencies increased 100 times or more in most of the viruses. Also for the single-stranded RNA viruses, for which results are indicated with Δ, it was shown that concentration by FLDS is effective in 4 cases out of 5 cases.

(2-3) Coverages of the virus reads obtained by RNA-seq and FLDS were compared (refer to FIG. 3). In order to compare variation magnitudes of coverage for 3 virus sequences for which sufficient number of reads were obtained also in RNA-seq, variation coefficients (standard deviation/average indicated in percentage) were calculated. As a result, there was observed a tendency that, in FLDS, the variation coefficient became lower, i.e., more uniform coverage could be obtained.

Search of Seawater for RNA Virus

Experimental Methods

<Sampling of Seawater and Purification of Virion>

Surface seawater was sampled at 5 spots in total [Jam, St73, St79, St97, and St122] (refer to the following table). Seawater of each spot in a volume of 2 L was filtered through a cellulose acetate membrane filter of 0.2 μm in pore diameter, and the filter was kept at −80° C. The virions contained in the filtrate were concentrated according to the method of John et al. ("A simple and efficient method for concentration of ocean viruses by chemical flocculation", Environmental Microbiology Reports, 3.2 (2011): 195-202), and stored. The sample of the concentrated virus was dissolved, then the solution was subjected to cesium chloride density gradient centrifugation (274,000 g, 48 hours), and the fraction for the density of 1.30 to 1.48 (g/cm$^3$) was collected and purified to obtain purified virions.

TABLE 4

| Spot | Jam | St. 73 | St. 79 | St. 97 | St. 122 |
|---|---|---|---|---|---|
| Date (mm/dd/yyyy) | 12/21/2015 | 07/27/2014 | 07/30/2014 | 08/04/2014 | 08/13/2014 |
| Coordinate (latitude, longitude) | 35.199, 139.392 | 47.0122, 160.0192 | 46.9718, 166.7472 | 46.9859, −179.4263 | 47.0035, −151.4048 |
| Depth (m) | <1 | <1 | <1 | <1 | <1 |
| Salt concentration (ppt) | —. | — | 32.9282 | 32.8586 | 32.4992 |
| Chlorophyll a (mgL$^{-1}$) | —. | — | — | 0.29 | 0.61 |

<Nucleic Acid Extraction and RNA Purification>

The cells on the cellulose acetate membrane filter were pulverized in liquid nitrogen in a mortar together with the filter, and the total nucleic acids were extracted according to the descriptions of Uray ama et al. ("FLDS: a comprehensive dsRNA sequencing method for intracellular RNA virus surveillance", Microbes and Environments, 31.1 (2016): 33). The purified virions were also dissolved in the same nucleic acid extraction solution, and the total nucleic acids were extracted. DsRNA and ssRNA were fractionated from these total nucleic acid solutions according to the descriptions of Uray ama et al. ("A new fractionation and recovery method of viral genomes based on nucleic acid composition and structure using tandem column chromatography", Microbes and Environments, 30.2 (2015): 199).

The obtained dsRNA was purified twice by using a micro-spin column (empty Bio-spin column, Bio-Rad Laboratories, Inc., Hercules, Calif., USA). filled with cellulose powder (Cellulose D, ADVANTEC, Tokyo, Japan) in the same manner as that used for the diatom. A solution of the eluted nucleic acids was prepared (57 mM CH$_3$COONa, 9.5 mM MgCl$_2$, 1.9 mM ZnSO$_4$, 189 mM NaCl, final concentrations), and treated with DNase I (amplification grade, Invitrogen, Carlsbad, Calif., USA) and 51 nuclease (Invitrogen) at 37° C. for 2 hours. A solution of the obtained dsRNA was prepared (90 mM CH$_3$COONa, 15 mM MgCl$_2$, 3 mM ZnSO$_4$, 300 mM NaCl, final concentrations), and dsRNA was collected by using RNeasy Mini Kit (Qiagen, Valencia, Calif.). A solution of the eluted dsRNA was further prepared by using nuclease-free water (200 mM NaCl, 20 mM Tris-HCl pH 8.0, 2 mM EDTA, pH 8.0, final concentrations), and dsRNA was fragmented in the same manner as that used for the experiment performed with diatom.

<cDNA Synthesis and Amplification>

The U2 primer (5'-p-GAC GTA AGA ACG TCG CAC CA-p-3' SEQ ID NO: 32) was ligated to the fragmented dsRNA according to the method described by Potgieter et al. ("Improved strategies for sequence-independent amplification and sequencing of viral double-stranded RNA genomes", Journal of General Virology, 90.6 (2009): 1423-1432). After the ligation, dsRNA was concentrated and purified by using MinElute Gel Extraction Kit (Qiagen). The reverse transcription reaction was performed with SMARTer RACE 5'/3' Kit (TaKaRa, Japan) using the U2-comp primer (5'-OH-TGG TGC GAC GTT CTT ACG TC-OH-3', SEQ ID NO: 33). After RNA of the DNA-RNA hybrid was removed, cDNA was amplified by PCR using the U2-comp primer and UPM primer (attached to SMARTer RACE 5'/3' Kit). PCR was performed by using KOD-plus Neo (Toyobo, Osaka, Japan) under the following conditions: 96° C. for 2 minutes; and 30 to 35 cycles of 98° C. for 10 seconds, 60° C. for 15 seconds, and 68° C. for 2 minutes. Small molecules such as primers contained in the amplification product were removed by using SPRIselect Reagent Kit (Beckman Coulter, Brea, Calif., USA).

<Sequence Analysis Using Illumina>

Sequence analysis using Illumina was performed in the same manner as that used for the experiment performed with diatom.

<Sequence Data Processing>

From the raw sequences obtained by the sequence analysis, adapter sequences and low quality sequences were removed by using Trimmomatic version 0.32 (Bolger et al., "Trimmomatic: a flexible trimmer for Illumina sequence data", Bioinformatics (2014): btu170). The primer sequences used for the cDNA synthesis and amplification were removed by using Cutadapt version 1.9.1 (Martin, "Cutadapt removes adapter sequences from high-throughput sequencing reads", EMBnet. Journal, 17.1 (2011): pp-10). The PhiX sequences added as the control, and experimentally contaminated sequences were removed by using Bowtie 2 version 2.2.5 (Langmead & Salzberg, "Fast gapped-read alignment with Bowtie 2", Nature Methods, 9.4 (2012): 357-359). Sequences of 50 base-length were removed by using Trimmomatic version 0.32, and the resultant was used for the following analyses.

The obtained sequences were de novo-assembled by using CLC Genomics Workbench (CLC Bio, Aarhus, Denmark). On the basis of these assembled sequences showing average coverage of at least 3, contigs were manually confirmed and extended by using Tablet Viewer version 1.14.10.20 (Milne et al., "Tablet—next generation sequence assembly visualization", Bioinformatics, 26.3 (2010): 401-402) and PRICE version 1.2 (Ruby et al., "PRICE: software for the targeted assembly of components of (Meta) genomic sequence data", G3. (Bethesda) (2013): 20; 3(5):865-80). Among the contigs finally obtained, those showing average coverage of 10 or larger, minimum coverage of 3 or larger, and length of 500 bp or longer were used for the following analyses. In particular, when dominant reads (more than 10 reads) were stopped at the same position, the position was recognized as a terminal end of the contig, as in the case of the experiment performed with diatom.

Results

<Search for RNA Virus>

Seawater sampled at 5 spots in a volume of 2 L, 10 L in total, was searched for RNA virus. In the sequences reconstructed from the obtained sequence data, 656 novel RdRp genes were detected, and it became clear that at least 656 RNA viruses existed. A part of these RNA viruses showed homology to viruses of 27 families among 44 families of known non-retro RNA virus families, and it became clear that closely related species of more than half of the known non-retro RNA viruses inhabit in seawater (refer to Table b mentioned below). According to the researches for RNA virus conducted so far with 175 L of seawater, RNA viruses of only 7 families were detected (refer to Table a mentioned below), and therefore it was demonstrated that the method is an extremely efficient RNA virus search method.

TABLE 5 a
175L → 7 families(*)

Alphaflexiviridae
Alphatetraviridae
Alvernaviridae

TABLE 5-continued

Amalgaviridae
Arenaviridae
Arteriviridae
Astroviridae
Barnaviridae
Benyviridae
Betaflexiviridae
Birnaviridae
Bornaviridae
Bromoviridae
Bunyaviridae
Caliciviridae
Carmotetraviridae
Chrysoviridae
Closteroviridae
Coronaviridae
Cystoviridae
Dicistroviridae*
Endornaviridae
Filoviridae
Flaviviridae
Gammaflexiviridae
Hepeviridae
Hypoviridae
Iflaviridae
Leviviridae
Luteoviridae
Marnaviridae*
Megabirnaviridae
Mesoniviridae
Narnaviridae
Nodaviridae*
Nyamaviridae
Ophioviridae
Orthomyxoviridae
Paramyxoviridae
Partitiviridae
Permutotetraviridae
Picobirnaviridae
Picornaviridae*
Potyviridae
Quadriviridae
Reoviridae*
Rhabdoviridae
Roniviridae
Secoviridae*
Togaviridae
Tombusviridae*
Totiviridae
Tymoviridae
Virgaviridae
b
10L → 26 families(*)

Alphaflexiviridae
Alphatetraviridae*
Alvernaviridae*
Amalgaviridae*
Arenaviridae
Arteriviridae
Astroviridae
Barnaviridae*
Benyviridae
Betaflexiviridae
Birnaviridae
Bornaviridae
Bromoviridae
Bunyaviridae
Caliciviridae
Carmotetraviridae
Chrysoviridae*
Closteroviridae*
Coronaviridae
Cystoviridae*
Dicistroviridae*
Endornaviridae*
Filoviridae
Flaviviridae*
Gammaflexiviridae
Hepeviridae

TABLE 5-continued

Hypoviridae*
Iflaviridae*
Leviviridae*
Luteoviridae*
Marnaviridae
Megabirnaviridae*
Mesoniviridae
Narnaviridae*
Nodaviridae*
Nyamaviridae
Ophioviridae
Orthomyxoviridae
Paramyxoviridae
Partitiviridae*
Permutotetraviridae
Picobirnaviridae*
Picornaviridae*
Potyviridae*
Quadriviridae*
Reoviridae*
Rhabdoviridae
Roniviridae
Secoviridae
Togaviridae
Tombusviridae*
Totiviridae*
Tymoviridae
Virgaviridae*

(Culley, A. I. et. al., 2014, *Mbio*)
(Steward, G. F. et. al., 2013, *ISME*)
(Culley, A. I. et. al., 2006, *Science*)

<Presumption of Completely Unknown RNA Virus Using Full-Length Sequence>

This method enables detection of presence of a completely novel RNA virus, even if an obtained contig does not show any significant sequence homology to a known RNA virus gene. In this analysis, 705 of full-length sequences considered to be derived from dsRNAs were obtained (SEQ ID NOS: 34 to 738). More than half of the full-length sequences did not show significant sequence homology to known RNA virus genes, and many RNA virus candidate sequences were obtained (FIGS. 4A to 9E).

Environmental Microorganisms in High Temperature Acidic Hot Spring

Experimental Methods

<Sampling of Hot Spring Water>

High temperature acidic hot spring water of Unzen, Kyushu, in which RNA virus had not been found, and dominancy of archaea is presumed, was filtered through a cellulose acetate membrane filter of 0.2 μm in pore diameter, and the filter was kept at −80° C.

<Nucleic Acid Extraction and dsRNA Purification>

Nucleic acid extraction and dsRNA purification were performed in the same manner as that used for the experiment performed with the diatom sample.

<cDNA Synthesis and Amplification> cDNA synthesis and amplification were performed in the same manner as that used for the experiment performed with the seawater sample.

<Sequence Analysis Using Illumina>

Sequence analysis using Illumina was performed in the same manner as that used for the experiment performed with the seawater sample.

<Sequence Data Processing>

Sequence data processing was performed in the same manner as that used for the experiment performed with the seawater sample.

Results

<Search of RNA Virus>

No contig showing significant homology to a known RNA virus sequence was found among the obtained contigs.

<Presumption of Completely Unknown RNA Virus Using Full-Length Sequence>

Thirteen full-length sequences considered to be derived from dsRNAs were obtained, and 48% of the total reads were mapped on these sequences. Although any significant value was not obtained in homology search using Blastx, the GDD motif highly conserved in RdRp was detected in a part of the contigs. Further, the sequences of both ends were conserved in 8 contigs out of 13 contigs, and it was expected that these 8 contigs originated in 4 kinds of RNA viruses consisting of 2 segments in consideration of base length information (SEQ ID NOS: 739 to 751). The above results strongly suggested that RNA virus also exists in archaea.

SEQUENCE LISTING (753 sequences)

SEQ ID NO: 1 - DNA, 1734 bp, Unknown
  Diatom colony associated dsRNA virus 1
gttaaattttgttcactcatttattaaaatatgtaatgtttataactacggatatatacatctataaacttctttggtctttttatagaactctaccgcgatacttgagctatttaacagtctttctaggcttgaactacttttccgcttggtccatattcacattaacacaattatattatggtttttccactctcgtttgtagttccgaatcctagaatagttgggagacagattgttagaaatagcccaagtggtcggggattaaacccagtttctggaggtaattccatttctggtgctgaatttgttaaaatgatagctaaggaggcttttaagaatagaaatgttctttctcttaatgctaacttccattataatggtggagggtcagatggcaataacaaagacggtgattctggtaaaggaaaaggtaaaggtaataacggtaatggaggcggtaacaataataataatcctaaaccccgtcgtggtcagggcgaaggtagaccttattatcctcacaaaactgttaaaactggtaatttagattatcgctctggtataaagagtggtactcttagaaatgctcgtgaagtagaaagtagtactgagtatagtacatgttacatccttaatggatctttcttttctgatcttactgtttctagtcccttctacgatttaatggttaaagatatttatcaatcttatcttgctgtcgttaggaagaatactaatgttagaacagctaaatatttttcagaaaccgcgtttttcgattacattaaagcaattagttccgcattacaaacctattttgaagtcgaatctattttggcttacaatattgaaccagctaatatcaaccaagggatgcttgaactgcaatacttattggatcctgaagttttaggtcaacacgaacggcttaaaaatactttacttggtactcctatgcctaaggacctggttttattcttttgttatatgtactcgaattttactttcgatccacatcctggtgggcatatatatagattaggttttcgtaaaacccttgtttttgattcacctcagaaagtgagttatggttattacgaggtgctgaaagacgatctgtttaatgttggtgaggtcacttcaatactttctaagtgttttaagaaagagatgttctttgatgaatttcctagagctacctcttctgtcatatttgacgataactttagaacattctgggctaatagttctctgtcttattttgataagagctctgacaacgtcaagtacacttttagtgtacctaattcttctacaaatacaaattattttgaattttgtgaggatgaagttgatggcatcttttacgcttgtaacagtatgtattgtagagatataaatttgtttaaacctggtctttggttacctttacaaggagaaggtgtatatgcaaatgaaaaacctaaccaatgttgtaatttactatgttactgtagtaattacggtggttttgttagtcctgaggcttacagaactgctataaatagcgggattattcatactattttctttgattatagtgaatctcgtttttatcatttcgaatgcttttatccttcttctaagaagatacaagtacacagtgttgacaatgtcgctagctgtctgtttgaatctatcttaaaacttttgaatgtttagttcggccaggagtacttaatgtactccctc

SEQ ID NO: 2 - DNA, 1562 bp, Unknown
  Diatom colony associated dsRNA virus 1
gttaaatttttacaaaaagtcaattatggtttacaaaacgcaaaattttcgttacagctttatatctaaattaaatttagattctgtggcggtacgtaaactttcccttttacttaactcggttgtttctggttctaatgtcgctcagagatcacctataggcaagtctatgtccgctgcggatatcgtttctgcctggtcagcgatatttgaaaaagattcatctgcattgactgaaggattaatgagacaagagatgaagaacaagcagaccattggtccaaggagcatggctattccttggtcgcttagatcatcaagtgtgcatgattattactcttctgataataatcgaaaattaaagaataactcctatcataagccctatcgcaccaataggctgagacccattgagttgaagaaggccctttcttttattaagaacaatacgaattccggattaccgtcactgactaggaaaggaatggttaaagatgcattggaaaagagtcttaatcactacttatcacgaaaagatccgtgtgtgttgtttactagaacacaggaggatttcaagacacgtaatgtttggggttaccccgccgcagacgtcgttaatgaaatgcgatattaccgtccgattctagattatcagaaaggattaccttggagaacagctttagttagccctgaagctacagaccttgccattacacatatcatgaaagaagctagagaaaatggctttttccttgtgtcaatagacttctcatcttatgacgctactgtctcttcagagaaacaaacccgtgcttttacttacgtaaaggatctatttcaatcagcttatagtgaagaaattgattatattgctgaacgatttaatactattggtttagtcacacccgacggtattcttacaggtaaacacggtgttccatctggcagtactttcactaatgaaattgattcaatcgttcaataccttatcgctaaagattttggtattagtgacgaccacatgaatatacagggcgatgacggtgtatattgtgttaaagacccttctgctttattaaaacattttgaggaaaatggtttaaaggttaattacgaaaagagtcttatttcagattgtgaatgtttgttccttcaaaattattatagttttgactatattaggaacggacaaattaagggtatttatcctacataccgagctttatgtagaattttatatcctgagagatatacaaactatagtgttgagggtatagccggagccagttataactcgattagaacaatttctattttagaaaattgtagtcaacatccactattcagagagtttgttacatttatctattctttagataaatattgtttaagtttcgaatctgtggaattgtctaaatatattaaacagaatgtagactctaccggcacagagggattatttaactaccgacgcggtttagatttaaaaggtatttataaattcaaaaccgttcagttaattaatgagctcaattcgggataaacatcttttgatgtttatg

SEQ ID NO: 3 - DNA, 4026 bp, Unknown
  Diatom colony associated dsRNA virus 2
tgccctcgggcaaccctccacttcggtggagggctcgctggttaaccactagtgtggttatactgagttcaaatctcagcttgggtaggggaaggcctccctaggatttcctaaattggtcagttgatctgctttggcggcagtataatctagtcatctttcgtatacttatttacacctatttatggaactgaatcgcttcgcatatagactcgggcaaagaactgctgatattataatagctggaataatggtagctccagctccaaaagtttatagaaaaattaaaaagattgcaaaactaagaaaaattagatcacatgttccagctgaagtaactgagaatgtatttgaatgtcttcaatatttagattaatttcaaattttacttataaaattaaattaattaataatgaggtttttaatatgtccgattctttaactggcgcgtgtaaagctttcatttgttcatttgctgctggaatgaccgataggcttgcttccagggcaacaggagttgaggtgagaattttgaagaattgctttactgatcctgctgaatgtgaaccttgggacgaacaatttcaggatggtgtttttgacgtaattttagaaactgcaaagaaggggaggtatcttgatgcagctgcaatggctctcgaaggtcccagtcccgatgcagactcattttgtattaattacgttgttgatgaatttctaaatatgcataaacacctggatgacgagtaatgatctgtgtagtaaagtttataacactttactacgctgtaagtttcttaaattatatatcttttttataaaataattatgaataaatgggaagaaatttcaaataatcttgattctgaagagatcattgaacatctgaagaaattaaaagattctgaaatatacaagcactattcaccagattctgacgaggttttatgttcttttaagaatgagaaagacgttgttgactttctcgtagcttgtgaacctataacaatagactttagttctagagaagtaacttattctttatctaagaaaggagtcgaaaatgaaatttttgatatagatatctcgaagtcattctcaatttccgacacttggctttacgacaaactacatcctgtgaacctggtctttccaaatgctgtcgactccgaactaagttctgaacaaaagaatttgtatatttgcttagtaatatctggagtcttaggagacattttcgaagaagaatttctagagttagtttcaaattatgatttccgaaattgggaatcgaaaggggaatccacgttatcatttactgcactttgtaaagaatgggttcaaatggattctataattgtaaagatggtggcttctgccgcaagatttgcattatctagagaaaaagcgaaaaaagagatcccaacggcactgggcctgtcagaggcagaggcttcagagttgcgtaacctgatgaagagaattgaagatgaaaggtacaattacgacaacaacattttgagtgacgaaaagaagaagggaatgagtaagctggacatcaaaatcaaaatacgagaaatgaatactaaaatttcagatattttgaaagagaatccaagattacacgagttgtacaaacttacaaatttgaattctcgtaatataaatcctattgtttatcgtgattctcagttgaagtcgaagaaagaagcagtgagattatttcaaaaatttagtggtagggaggtaagagacgataaagacaaattagaagtaagcaagatagcgaagactctgatgagagagtcaatgagagcgtgtgttaataagttgttttctgaggaagctgaaatatacagaagaagtcctgataactacaaagctccggatttcgtgtaaggcgtagaatgaaatcgctctcgagcagattcaatgttttttataaggtatgttgtgactttctagataagcattctcgagatgcttactataattccgattcttcatatcccggattttattcttcaacttacaaaggttttgatcctaataaggtctcaaaaagacttaagaataagaaaaagaaaatattcaatccgaatattgaagaagggaagaagataagtaagtcttcattaaagagaagagagaaaagaaggagagattacttcttaactgaagatggtgatgtcttcagaagagagagtaaaggtgatatatttacttgtgatggtatcaattgtttcaaacacaaagagacttctaatgttcgtgtcggaactagacctcaaaaatttgatagaccacctgaatgtaatactgatttcttcttccagttcaccaaggttttcgaagaactaaatagtagagaggttcttgatgaaaaatttgaattaaacagacatgttatcgttgacggatgtttcgatacaaataaacatgtaatacaagctcaaatggattgcaagaatttcctaggacgggctactccgagtgaaagacatcttaacatgatggctgtagcagtgagggatgcaattaggaaattgaaaatcgaggaccttggtgacgtaagtatcaatgatattcgagattttgatttcaatctagatacaaagcctggatttagattcgaacattacttgaagaaaaattataaaaaagattgtgttgacgaggcggtctttttagcagaagaaagatatgcttcgatcaacaaagcatcagctcaagggagatttattacgcgcgatgaaatatgtcctggattctacactattggtgctagaagtaaaagagagaccgatccaattgaaggtgatgaggccacttccagggcgatacacattccagagtttcatgttgaattacacggtggctgtttcagcgacaaaataacatcacacttcattcagaaaggggaaggtccaattttcattggaaactctttcacgaagtttgataggtttgggaaattattagatttaaacgaatttgcagttgaaggagattggaagaaatttgattcaacattaagtaattcactgattacattcgctgtaggtatttgcaggttgtatttccctgaaggaatcttatatgataatcattttctcgcaattctagattcactagtaatcaaggattaccatgtcgttggaggcagggtttaccgaattttacacgggctaccttcaggtagtaagtggacttctattattgggtctataattaatttaatcgccttgaactacacattcagttcaataaaatattatgataggtcttttgcaattggcggagatgacttcgtagtttttgtaaagaatgataagtatgaaattgatagtctgcaggaaactgttgaagcaaaggcggccgagattggaatgactattaagtatttcaagttgaagtgttttaaaggtagtgacgacgtaaatgactttccagtcttttataagtacactgtttttaaaggattccctataattccacttgaatctgtaataactagagtcttttcaccctggaataaaagatataaatcaaattctgccgttcttggctttcttgatgatatttttccatctttagctgctcctagtacaggttgttacttgttttatttattatatatctacatttactatagagtcactaagaaattgttgaagattgaagacttagttgttagacacgaaagaattttcaataaagtaatgagagaggatttagactctcactttattgaagtcttcaatgtcaacagcgtaagtattaaaagaaattttatggccgggaagttgaagtctagcaaagatttcctaaaaaaaatttttaatttttagggagttccctttgtttagaattttcttcctctctgattgtaaggtttaatttaaacttcgattctgctatcatagtgaataaagacaatttttaaagaagaagagagaagagcgtccaattaagaaaatacattgttttaaaactaggtattatttcttaattgcgacgtgtgca

SEQ ID NO: 4 - DNA, 4911 bp, Unknown
  Diatom colony associated dsRNA virus 3
tgaaaaaattcgcgttgcatcttagcagtgtgagtttttagcgaaagcggtattgatatattgatgcttacccctgatttaacgagaatgtcttggccacggtaagggccatagcgcggtgcgttccaccgtgtagggaaacagagcttaacctgaataaggcgggctcctaagtactgcctcattgcgatcgttattacttcagtattatcttacgccatgaagctttcagcatactttcccgtgagtgccaccttaggcgcttcttctctgtacgattctccgactccgaactggcgtcgcttgtccgttgcttgtaagcacactgtgacaggccgcgttgctggcaaggatcgcgcaggatcggcctccgttcagtacaattctgacttccgccccgctgttgatttgggagaagttgtgaacttggactcgagtgttttgattgccttgcagtcccgtgacgttgtcaagtcccacatggacaagttacgtcctcgtcttccttacgacgtcagtgctactactcctggctttgctgacttccgtgctctcatggcggtcatctcagctgctgaggctgctggctctgcgcgtcagagggttatctattcgagaggtactgctgagtatcaagttacaccatctggtcatcgcgagccccgcatcggggatttgcatattggaccatcagtctgccgcacctcgagggagtttatcactttcctcaagttagtcggccaagctggagtcaagcgcgtcacgattctttcggacacgtcgttgactcctgaagccgtgcccctggcgggtcaaggactcgctgttttttgtgccaagatcaaggccattgtccagcagggagcgaacgaactctgtgcctacggcagtcacgagctagcgagtgtcggcggcacgacagcagccatgagcctcaacgcgcattcggacgaaggcggttgggtgcgcggcatgttgacttctatgtcataccccccctccactggtattctccttggaactgggagctcttttaacggagtccccctccaggagtgtctccacaaagaggacatcatgaccaaggtcatcgcggattatctttcatcgattgccttgctccacgttgcggatgttaccttgaacggtagcacctccgtctatgagcgtgagcccgggtcgcgtgcgtgtttagactcgtacgggacactctcggccgacattgatcgtgtccttgagcaatgggccctcctcatctgccgtcgtgatgacatgcatcccgatgcaaccactgacggctctgctttttcagcgtgctacgacaggcgcgctattgaccgtcactttgaagacaatctgaccatcgtcccctggtggtttgtcgagacggcgcctctcctgttggagtcgtacccaggctatgatgtttgcgcccgccacggcacaatctccaaactgcctctccttaacgtcgaggaggtaacgcatgactcgccggttcttgatgatcgcggccgcgtgatgcacggcgcgacggttggattcgtccgccgctcaggccctttcaggatggagggcgcgagctatctcttcaacgagcgctactctgacggcgagacactcgctcgattcaggatcaacgaccgctcgatcaggaagccgagtgacgccttcatgtttgcaggcgatacgggccctgacattgagtcgatgcgttggaaagtgccccataatcctcttcctcatccacttgaaggcatcagtgatgccgcagttgagttccaggcgatgagcgtttcctacttggaagatccgaccccggccgatctggccagcgggacggttaattcattttttggactcttcagtgtcgtccagaagacggaggccgcagcacgagttacctatcgaggctgtcctcgcaccttgcggcgcaagatgaagctggaaagccctcacttccagcgcctcttccgcatcaaagtaaatggtgagccaagtccgccccgtccaggtccaccacctgtccaagaacatgccccgcctctcagcgacgttgagtcagttgacgacaattcggagttgagcgaggctgatgatccaggcccccctccgcctgacgtacctactaccgaggctgtgcctcgtccgccgcaggattctgaccctgctggcgaaaacgattttatctctagtgctgactccactgtccagattgcccgttccggcgatccgatgagccgtcccacccctccgatcacaacgaaggcagtcaaagtaactgcagctggcaaggatggaggtgcgtcggcgactcccgtctagtgtgctaagccggctcgacggcacatgccacacccttaaggaggcggaggtctgtataggggtggccgaacgagccgcaggcactataggcatgctatatgttgcagataatatttttgatatccccgttcaagttcctggggatagtgtgtgttttgatgagttgctctattacttagtcaagtaccaagctaagcctgacacgttcacccacggtggaggtgttgcgcgtggtactagacgaaaaaagagacgagttgtgtccgtgaaaggtgatctgatggcgcagtaccacagtaaggtgctgtcattttgctctatcatggatgaaccactaagtgaaggtcctgttgggccggatacggcgtgggatactttgtcggccaaggcgtggtgggctggcaaagaagatttagatgtatttcctgagcgttttggcacacccttcgacaagacgaatatcaggtttaaaagactctggcgagatgtgtgccagtactttccccgtgtagcgcgcgttgtcagacgagaacgcgtgatcttacagggttacacccacgatgaggcgtgtgggtggttgatttggctctgtgcctctcaagagattcttggaggtgcagcgctcgcgttcgtggctgtgttcggtaaacatgcaaagttcctgaaattactgaacacggctgtgaaggcctttggattacagcaggccaggtggggctctgctgtctgtgaactcagcacactagccgggcgcggggttggtgaattagttcctgatgaggacgtgaggacacgtgttgattacgcggcatttctggaggagaaagcagccgtgtgtgagagagggcgcctgcggtcgtgcatagaggctgtgattgcacgggagatggctgagaaaccggtgtggcacacgaaagaggagtactggtcgcgccgttggctcttcaccaaatcaggatcgcacagtcgatcgatggaacgtgagtggtttggtgagaagctggatctgccgccgctggccacgaggcgcgagtttgctgaagcagtcaaggagtgcatggttgcttacggtgagccccgtgtggaggcaggttacagtgagaaggctgagcatggcaaaacacgagctatctacggatgtgatagtgtcagctatttcacgttcgactacctcctcaagccagttgaggcggtgtggcggaacagtcgtgtgttactcgaccctgggcgtacgcctcagggcctgcggtacaaggagttggccgagcacgacggttacaagtatatgctggattttgatgactacaatagtcagcatgagattgaggccatgaaaatggtcattgagatagcctgtaaggacgcccccccggacgttttaaaatgggctctagactcgtgggacaacatgtttgtccactgggtctcgaaggacggcctgaagaggtcgaagatggtgggtacgctgccgagtggtcacagagccacgacgttcgtaaacacaatcttgaacgccgcctactgtctgtacgcaagcagtacggatatgagtgagttagacggctaccactgcggagacgatgtgattgtcttcggtgatgagagagcgatgtccctgtttgtcaaggacatgtgcaaatctgtcttcaaaatcaaccctgccaagcagagcgtgggtcaatacaatggtgaattcctgcgtgttgccttcgaccggcggggtgcgagcggatacggtgctcgcagtattagtgcgatggtaagcggcaactggacaacagacaaccgccttgataaaacctcatacatcgacactatgctgcgtaatctgtggacgttgtgcgcccggttccgaacggaccgtctgggtgtactgggcctaacttgcctacgtaaaagagcgcctgaggtagttccttgggcatacgggttagtcacccatgagatcagttggaatggatcgcctgtcaagctgtcaggccggggagagccagtgcttgtcctcagatccactggaggccgttctcgtccacgtcctgaacgtctgaagaagactttcgcgagtgacgcgatgttgtcaaatcacatcgatttcacactcatggacgcggccgggatcgcgccgtcccaggtccactcggccctcgcggctgcctctggcaaaccgcgcgagtacgaccgtgagagtctgctggacatcacggaggagtggtcgtccaggtggggcgtgtactcaatgggtacgatagccagcatgcacactcgtcctactgtcacgagcagtgaggcgctgaacgtgctgagcaagatgttcaccaagatagactgggtggacatagtgcgctctatctacccacacattggcggtgagctgagtgctacaggcaccagcccatggccgctggttgttgactacaaccttccttattcggactgtatggcatacagaaacaaggtgactacgacagtcggcctccttgtgacttatcctgttacagtttaaggtccgttcatatctggttacgacactgttcccaggccaggtgagaagactcaccgaaagtcgctgcatgacttacccaagca

SEQ ID NO: 5 - DNA, 4982 bp, Unknown
  Diatom colony associated dsRNA virus 4 genome type A
tgaaaaatgagctaacattagattagttgattttagaaagtcatttatatgacatctgtttttggacagtaattcggcagaaccagtaagaggtagagacgcaaatcctatcagacgactggggaaacgggtgcatcgacggtaaatggcggggatatgagcccgggccaaaatggtactagggaaccgccgggtgcgtggtagcagggcagcgatgtcttgctttagtaagcgtctactagggtaaaacctagacatgtatcggtaccacgggtaattgttcggctcttgcagtcgaagtacctggagtagctagtgtaagactataagcgacttaaattgtcagtgaccagagcactggcgtgtttagcgtaactcgataaaccgctccgaacagtgaaatccaaggaactcatatttttacttagtcatgcttctcaactctgtccaatcccgggaattcctcaagaaggctgccttcactagggttctcggaaaagatggtaaagccgacccttccaaggccgactttcgccgcttgtggctccacagtacgcaccatgtctctgccgagatgtgcggtcgtactaagacggggcacgccagcgtctggtacggcatcgagtactcttcaaagcgtatcgatccgaagtacagcttgaccatcgacgactctatcccagccatcgcgtctcagtctctgagcaccatcgtctccaccttgaagactctcggtgctcgtcacgctttggccgggacttctgagtatgactgtccgtatgatatgcgagcccttggcttcatttgtggatttgttggcgctgccacctctgtgggcgtcgatccacttctcaacgacaagtcggctgtaaagccactcaccgctaacactgctatccatctcggtaccagtgccagcttttctgaaacttgcttctccaaccaggatgaactggtctctttgacctatctcactggagcagccggtctcaagtctatccgcctcgccacccagacggcgtcctctagtggacgctgcttgaagggtgaggctcttggggtttacgccctcaagctttatgcaaacctcctcgcggagtctcattatgtgagcagctccgctgatcttgctgaggctaagttcagcggcgagctcgccttcttcaaggtcttaggccattcccacgaagggagcggggtccgccaggccctcatcaaccgttcgtacccaacgcctgttggttttgtcaaccctgttgccaccaacatccaggggcttagtaccgtggcgtctctccatacgtccgacttgctccgtcatgtagtggcctccgtccttggtggggtcgggaggatcgccaggtctgacccgacccgcagcgaggagggtttgccaaccatctatcgccctaacccgagcacgggatgtcccagcagcatgcctggttttgagttcgactactacaagatgttgtcgaactggaggactaagattgcgaaggaagagggtctcgcctgctctgattacaaggacgggatgtcgagccgccgtttcttcgacgacgacgaggagaacgaccattataagcgcaaggctgttgtccccttcttctacgtcgagccgggtcccgtctctacgtctcttgattctagtatcaccatgcttggttgtcagggcgaaggagtgagcatcccgctggtcgagaaagccgagggctacaagactttagcttacggggagtataacggtactccttttcccggcagcgtggtgcgcctggtcaccaggagtgggtacgccgctcgtcgtagtggaataaactacttgatgtccggtcgatacacgcgtggtaacggcctctctcagttccaccaggtggcattcggagccagcggtatctttacgaacgatatggctatgtccggagcgtcagctggctctttgtctgataggaggtggcatacgtaccactgtccgctccccaatcctggagagaatttcacgaataagcctgcttgttttagttacacctactccggtggcaccgtggagcctaccttggacgagttcgtctctaccaaagtagacagtctgttcggtacattgatcgtcgggaagccgggaactagggatgcgacgtatcatcgtgatattcctgaccatctggccgatttggtgtcaatgaccgctggtgttttcacgttcctcacttctcggagcaacgtggtggacatggcctcgcgagttgggcctgaaggggggaatttcgaccccccttcgctgcccgaagctccagcacctttaacgctagctgaagtcggcgacactgagcagttggagagggacgatgagcccgaagacccaattgagctaggcgaagaagagcaaaacgaactccctgagggtagcacagtcctccgccccgatacgacggcaggaccggctaccccaggcagctaatgctgccgagctacctagaagaacggattggaaagtgtcgttctttgagggaagctctaacagcgctttctctagctaaggccgtctgtaccgggcctgagttagtaaaactaggcttagaaatgtgggatatccccctgcaagtcgaagccacggtacaggacgtattggagtatggttctaagctactgcctgctcctcacgaaggcgaagtagttgagtcagttctagacagggacgacgacaggaccgtttttcctttgaagctgcatccaggggcagcgacaaaggtaaacgtgttctttcgtgacgtctgggctgacgccaagaggcactttagcaagccggctgcctacttaagtaggcatccggagctattggttggattgttcaatgaccaggcatctgcttgggtcatttggttctgtttaacttgggaggaggacccaagggtagcagtatcagttctgaacgagtgtcagaacatggattacttgaaggagttgtccgacacggtcaaggccctgggcatcacccgtacgaagctggggtgtttatgcacggagctaaagaccatggcttgtagaggcgctaagagcttcgaccctgatgaggaggtcaggtgcagggttgacaagaaggctttcagagccgagaagtcttgcaagataactggcgagcagataaggccgtatgtacgccaggtcctgcgagaggagatggccaagaaccccgagtgggctggagttaaggagtattggcagaggaggtggctctacacgaggtcgggggcgcacgccagaagggtggaggacattaagttaggtggtcggcttgatctacctgaccgcccaacgcgccgggagttcgctgaagccgtttcggagaacatggtggcgaaaggggagccgggctgccatgcgggccagagcagtaagttggagaatggttccacgcgggccatttatgctggtgactcgattaattacttcactttcgactatctactccgccctatcgaggcagtctggcgcaacaggagctgtctacttgacccgggagctcggcagccgtctgagctttacggggcactagctgcgagtgctgacgtgagcctgatggtagacttcgaagattacaacagccagcacgaaaagagtgctatgaaagttgtgattgaagaggcttgtgctggggcccctgaggagatcctcgagtgggcgttggcatcaatcgacaatgaggtggtgtactgggtgtcagctgacggcaccacgaagatggccgtcacggtcggttcgttgttcagtggacacagggcgacaacctttatcaacacagtgttaaacagtgcgtatattagatacgtgtgtggcacgttaacactaccaatgaagtcataccatgcgggtgatgacgtttacctcagcgggacggccgaccaggtggagcatgtcatgaagagcgtgctcgccagttctgtcagggtgaacaggtccaagcaagggtgtgggaagttagtaggagagttcttgagaactgcattcaccagagagtgtgctcgtggctacatggccaggagcgtcagctctttggtgagtggaaactgggtttccgaacaggtcgggaccgagtcggaggacgtggccaactacgcaaggcaaggttggacactgatggtgagatcgggatgcaggagagcagcgtggctgcttagaactagtatggagagacggttgccgcggattgcccacctggtaggggctatttgcgacttccgtttgtctgtaggtggttcgcctgtgctcgataggactggaggagactgcgaagtcttgatgtttgtgaaggaacagtcggcgaggccgcgtctggacgggaagccgtcctgtgcgaccgacgactttctggacaattatgtaaaggatgagttgctggaagctgccaatatgtcccgtgaatccatgcgaaggctgatgctagaagtgtcgtacaagccggagccaagagaagaagggaaagaagctggggagcatccagtagtgtgtccggtaccgaagaggtcgttctacggcgtggcaatcgccaggcaggaacgccttcgggaccttacacgcactgaaagcgctgtcgccaaactcctggggagattggtgagcagtgtggactgggaggcgctggttcgagctattgtcggggataagtcagtcttagcccctaagctggatccaaaagctttcccggtcacgaatgccggaactttgggggtgtcggaattgatggcgttgcgcagtaggtcggccagacctatctgcgtcgcaacgcgctttccaatcttcatctgagcccggtaacagcttcgccacaccgctcccgagggctttcgcgaccagggagcggttgtggtatggagtagcaggcacggcgcggggaccatgtagtgcgtaggatacgcgcgacagtggtctaaccgctgtgtactagcgctccacaagaagagattttaaacaatctcatgtgt

SEQ ID NO: 6 - DNA, 4979 bp, Unknown
  Diatom colony associated dsRNA virus 4 genome type B
tgaaaaatgagctaacaatggattagtgattttgataagccactcctgtggcatctgtttttggacagtaattcgggagaaccagtaagaggtaggacgcaaatcctatcggacgactggggaaacgggtgcatcgacggtaaatggcggggatacgagcccgggccaaaatggtactagggaaccgccgggtgcgtggtagcagagtagaaatgctctgctttagtaagcgtctactagggtaaaacttagacatgtatcggtaccaccggtaattgttcggctctcgcagtcgaagtaccaggagtagcagcgtaagacgataagcggcttaaattgtcagtgactagagcactggcgtgtttagcgtaactcgagaaaccgctccgaacagtgaaatccaaggaactcgtattttttacttagtcatgcttctcaactctgtccaatcccgggagttcctcaagaaggccgccttcgccatggtccccggaaaagatggtaaagccgacccttctaaggccgacttccgtcgcttgtggctccacagtacccatcacgtctcagcccagatgtgtggtcgtactaagacggggcacgccagcgtctggtacggtatcgagtactcgcgcaagcgtgtcgatccgaagtacagcttaaccatcgacgactccattccagccgttgcgtcccagtctttgagcactatcatgtccacgctcaagactttgggtgctcgccacgccttgtctggaacttctgagtatgactgtccttttgatatgagagcccttggcttcatttgtgggttcgtcagcgccgctacttctgcgggcgttgacccccttctcaacgacaagtcggctatcaagccactcactgctaacacagccatccatcttggaacctgtgctagcttttctgaaacctgtttctccaatcaggatgagttggtctctttgacctatctcactggagcaacaggccttaaatctatccgcctcgccacccagacagcctcctctacaggccgctgcttgaagggtgaggctcttggggtctatgccctcaagctttacgcgaacctcttggccgagtctcactacgtgagcagctcggcttatctcgctgaggccaagttcagcggtgaactcgctttttacaagatcttgggtcattcgcacgaagggagcggcgtccgccaggctctcatcaaccgttcttaccccactcccgttggttttgtcaaccctgttgccaccaacattcaggggctgagcacggttgcttccttgcacacctctgacttgctccgccacgtggtggcctctgtgctcagcggtgtcgggaggatcgccaggtctgacccaactcgtaatgaggagggcttgcctacgatctatcgtccgaactcgagcaccggcaagcccagcagcatgcctggctttgagtttgactactatcagatgttagctaactggaggaccaagatcgcgaaggaagagggccttgctgactctgactacaaagatggaatgtctagccgccgttatttcgacgacgatgaggacaacgaccactacaagaggaaagcggtcgtccccttcttttatgttgaacctggacccgtgtccacgtctttggactccagtatcacgatgttgggctgtcagggagagggagtgagcgtcccactcgtcgagaaagctgaaggctacaagaccttggcgtacggggagtacaatgggactccttttcctggaagcgttgtccgtttggtaacgaaggaaggctatgctgcacgccgcagcggcatcaactatttgatgtccggtcggtactctcgcggcaacggtctttcccagtttcaccaggtctctttcagcgccagtggtatctttaccaacgacatggccatgtctggggacccagctggctctctgtctgataggaggtggcacacttaccactgccctctccccaacccaggggagaactttacgaacaaatcagcgtgcttcagctacacctattctggtggtacggttgaaccctcgttgaatgagttcatctcgacgaaggtcgacagcctcttcgggacgttgatagtcgggacgccgggtacgagggatgcctcgtaccacagggatatccctgaccatctctctgacttggtctctatgaccgctggcgtgttcacgtttcttacctctaagagcaacgtcgtggacatggcgtccagggtcggtcctgaaggggggagtttcgcacctgtctctctacctgaggcgccagcccgtctaactctggcggacgttggtgccacagaagagttggaccgtgacgacgagcctgaagaaccagtcgaactaggggaggaggaacaaaacgaattacctgagggcagcactaaccttcgtccagatgtgacgtcagggcctgctgccccaggcagctaatgctgccgagctacctagaagaacggattggaaagtgtcgttctttgagggaagctctaacagcgctttctctagctaaggccgtctgtaccgggccagagctagtaagattaggcttagaaatgtgggatatccccctgcaagtcgaagctacggtacaggacgtattggagtctggttctagactactgccagctcctcacggtggcgaagtagtcgagtcggtcctagacagggacgacgacagggccgttttccctttgaagctgcatccaggggcagcgacaaaggtcaacgtgttctttcgtgacgtctgggtcgacgcaaagaagcatttcagcaaaccggccgcttatttgagtaggcatccggagttgctagttgggttatttaatgaccaagcatctgcttgggtcatttggttttgtttagcgtgggaggaggaccctcgcgttgcggtctctgttctgcacgagtgtcagaacatggactatttgaaggagttatcagatacggtcaaggctctgggaatcacacgcaccaagcttggatgcctgtgcacagagttgaagaccatggcgtgccggggcgccaagagttttgatcctgatgaggaggtcaggtgcaggatcaacaagaaggccttcaaggctgagaaatcgtgcggaatcacgggtgagcagataaggccctacgtccgccaagtgttacaggaggagatggccaagaatcctgaatgggctggtaccaaggattattggcagaggaggtggctctacacgaggtcgggagcgcacgcacggcgtgtggaggacatcaagttgggcggcagactcgacttgccggagaggccgacccgcagagagtttgcggaggccgtctctgagaacatggtggccaagggagagcccggttgccatgctggccagagtagcaagctggagaacggctcgacgagggctatttatgcaggagattcgatcaactatttcacctttgattatctgctgcgcccgatagaggcagtttggcgcaatcggagttgtctgttagaccctggggcccggcagccttctgagctctacggggctctgtcggcaggcgctgatgtgaacctgatggttgactttgaggactacaacagtcagcatgagaagagtgctatgagggttgtgatcgaggaggcttgcgccggggcaccgaaggagatactggactgggctttggcgtcgttcgacaatgaggttgtgtactgggtttcggcggacggcaccacgaagtgggctgttaccgtcgggtcgctcttcagtgggcaccgagcgacaactttcatcaatacagtgctgaacagcgcgtacatccgctacgtctgtaacaccttggtactgccgatgaagtcgtaccacgcaggggacgacgtgtatctaagtggtactgctgatcaagtagaacacgtaatgaagagtgtcctttctagttctgttagagtcaacagatctaagcaaggatgcggtcggttagtaggagagttcttgagaactgcgttcactagggagtgtgcccgtggctatatggccaggagcgttagctctttagtgagcggaaactgggtttccgaacaggtcgggaccgagtcggaggacgtggccaactacgctaggcaaggttggacgctgatggtgagatcggggtgcaggagagcggcttggctgctaaggaccagcatggagagacggttaccacggattgcccacctggcaggggctatctgtgatttccgtctgtctgtgggtggttcacctgtgctcgataggactggaggagactgcgaagtcttgatgttcgtgaaggaacaatctgtgagaccaaacatggaaggcaagccgtcccatgctacagatgacttccttgacaactatgtaaaagatgagttactggaggctgctaatatgtcccgtgaatccatgcgaaagctgatgctagaagtgtcgtacaagccggagcaaagagaagaagggaaagaagctgaggagcgtccagtagtgtgtccggtcccgaagaggtcgttctatggtgtggcaatcgccagacaggaacggctcagggacttgacgcgcactgaaagcgctgtggccaaacttctgggaaggttggtcaacagcatcgactgggaggcactggtgagagctatagtgggagacaagtctgtcctggctcccaagcttgaccctaagaccttcccggtcaccaatgctggcactttgggggtgtcggagctgatggcgctccgcagcaggtccgcgagacctatctgcgtagccactcggtatccaatcctgatctgagccagcgacagcttcgctgccacattctcgagggcttacgcgaccagagagtggaggcagtacagagtagcaagtgacacacagggacctcatggcgcataggatatgctccatggaggtctggttgtgtcgccgatgcgctctacaagaagagattttaaccaatctcatgtgt

SEQ ID NO: 7 - DNA, 5252 bp, Unknown
  Diatom colony associated dsRNA virus 5
tgaaaaaagatccagttgccggttcttaggtgtaacagccaaaattagacgcaaccactcttcggagtgagggtaatagtgtgtttcgtgattaatcaaattaagataggatttgttgtgccacgacacaggtcccagggtgagtattcctacctgggcagcctctgggggaaactgcgtaccgacagcccaggccaaaatgagagcgtcaggttaatagcctgcgataaaacaaaactagctattccgataattctttaacagatttacgcactatgtccctttccaagttcattccgacttacacctctttgaccccgatgtctttcactctccgcgaaaaaggcggacgtgttactcggcttctcgttcttgcaacgccccatagcgtctacgctatgtttggaggcgatgcggtgagcggcaaggcggaggtgttttataagattgaaacaactggagaaaacgaaaccccagagtttttcaagtccggcgttgccttcgatgaggcccctatcgggtaccagagcgctgaggacttgcgtgcccttttggagatcatgcgagtccgtcagtcgttctcgcttgctgcgattggtgacgctgtcttcgacatgcgcggtgttgctttcacctgcggtgttatggctgcttcggtcactgccggcatcctctacgcctacaggttcaacgcgtgctccgtcggcttgttatccccgagctggaacgttccatccgtgaccaacctcacagttgccgttggtattgcggagaccggtcctgagttcgcaacccttgcacgtattgcggctgcagctggcgggaaaagcattactctcatgagtgatgtcatccctccgcgcactaaccgtgttttgcaaggattgtccctgggcgctttcgctcttaaagttttctgcaacgtcatcaacgctgcgcaagcttgttcttgcgcaggtatgcacgttgaagcattttacagcgggttgtgtagagttttcaagctacactcccacactgatgaaggaggtatgatccgagagatacttagctcggctcgttatcctccgtctgtcggtgtccttgcagttggagcctcgagttatttcgggctctcacctcgtgagaaactgatggacgtccatgttccgcaggtcgtcctcggtctcttcctcgagttgactggcaccttgatcacttctgatcctggtggtatggaaccgactatcctcgtcaaggacggagactctaaccgtccttctgacttccccgggttgaggccagctttttacaagcttatgagccgctttcgtaagaatgtctgcgatgattatggcctccaccatgcgctcgtcagcgacaccagttcgcatgacgggtattttgaaaccgatgctgaagataggcacttgatggccgacaccatcgtgccgtttttctgggtagaacctggccctttgtccacgaaggagagggactaccctttgcctatgattcagggcaagcaaactaatcttgacttgtcaagagcagaagttgtccaagaatcagcgggctatacggaagtttttggtcgcgtaccagtcggtgcagctgtttttcaccgtactgagaaggcccgcccaaggatggaggggtaccagtacattttgtcgcctcgttaccgtcctgaaaatggtctctctcgtatggaggtgatcactgacgataggcttggcgtcaccacctctgacgctctcttcgtcaaacctggcgtgaccaatgtctctcgtaggagatgggtcacaccccataacccagttccgtcgccagccgaaggtatcaccccagttgctcaggctacacgttatgtttacaacggtatgtatgctgaaccgactaagtcggactggaaggacgggaaggttgcaagtttctgtggtccctttcgcgtcgttaagtccacagtttcactcggggacaagatcacttgttctcacgtctcggagacaaaccgccgctggcttaactcccgcggtcgttatgctccaaaacatgtcttagacttgtcagcactccccactggttttagcttaccacagagggtgctaatgtttggcgtcgaagcgatgcctagatcgccagagggggcgccagaccctgaagacgatgcggagggaagaagtggagaaagcggtggtggatcgcaaggaacaaccagcagcagcaataaaacacccaatcgtatggaaacccagtcagcaacccctctccaaggagagcaagaggcacctaaaattgaagggcctcaaacggatcttgaggccgatccaggaacaggccgtcgcattcgagtaacggatgccgaagtggataccgaagagtcggtgggaagcatcgaccgctaggtcgcttcccaagtcggtggttcggctgttcgacgagccaaccgactccatacgagttgcgaacactgctgtaggtgtagctaaggcggtcagcggtgctgttggggcattgctgactgctttgtattgttacaccgtccccgtccaagtggaaggggttagtgtcgatgatgtaatcttcggcattgttgagaacgaactgagtgctggcgcacctggtacgttcattaaaaggagaaggttgggtgatcgagaattagccgatcgtcaatcattcaagggggccagattgaagctggaaaggaggactcgagcggcggcaaaattaggtaggagcttgctatacggccgtgcactcgaaaaggcggaaaaagactacggggcacacggatcttacgaacccgatgtgcttgcatggaaggtcgcgtcgcgatcaaggatagaggggtcaaacgttgagtttgatagtagaggcgacgttgcggttaggaaggtgtttcgcagcgtcatcgataggataaaagatggatacaacggctcaatggcggacgtgcttcaagtgcgtgcgcttttgtctaacccggacgttacgtcggggttaggtcttggaaggatgcaggcagactggcgacacgtcgttgggaggctagcatctatcaaagacaccgtagtaatgagcggtatgttgatcgagctcatagttctgaacatcataccagatgtctgggtggctccgctgaaggggcaccccggtgcgaggacaaaagttaacctatttttggccgacgtgcttaaagacgcaagaaaatatttcccgacatcatacaaagcactccccgcagtgtttgtgaatttgttgggcgctaacaacgacgaagtaaccggctgggtatcgtggtttgtgttagcacacacattcatgccccgagcggcagagctgatggtgtcccttaggacgatgggatcgctggtcaaggacatatcgactgcgataaaaagtctgggactcaactctaccagggagggcgctatgatctgcgagatggtagccttggcaggaagaggagcagtgccggggaacgcggatcttgacgttagcactcgtgttagtgagaaattgttcttgagagataaggcggctgtcatggacaaagaaaaactgcgcgaagctgttcgcttggtcatacgagaggagatggttcgtgatcctaaatggcaggacaaagatgactattggtccaagaggtggctgtacacgaaaagcggatcgcacacccgtcacatagaggatgtgatgtacggtgacaggttggaccttcctcctcagcctacgaggcgtgagttcgcagaaggcgtagaggcgaacgtcatagctgagggtgagcccgcggtgtatgcgggcctgtcgtggaagctggaacagggtaagacgagagcgatctacgggtgcgacacgcgctcgtacttcacatttgattacctattgggtccggttgagaaatgctgggccaacaagaggacgttgctcaacccagggttgagggcgcaggcggatttgtacgaggaccttgcttcgaaggggccctcgttctacatgctcgactttgacgactacaacagtcagcatgagctggaggcgatgaaaatagttatcgaggaggcatgtgctggtgccccgaaggaggtgcttgactgggcagttgccagttgggacaacatgtgggtgcgctgggtaagcgacgccactggtaagttggagaaaaagaggatggtaggaacgttgccgtcaggacacagggcgactactttcatcaacacgatacttaacacggcgtatgtgcgtatggttgttggtgatgcgttcgacaacgtaggatcactgcatgctggagacgatgtagtaatgtggggtgattcggaggacatctcgaagtgcatcaactgtgtcgagcagtcggtgttacgagtcaataggtcgaaacaatccgcagggagtgtttcaggagagttcttgcgcgccgctttttgcaagagcggggcacagggatacgcggcccgggcgatcagcagtgctgtctcgggcaactgggtgactgaggacaagatatcccctcgttcttacgttgacaacttcacaaggctggcatggacgatagccaaccgtagtggagtcagaaacgcaggtgcgttgtttgttagcagtctgagaaggcgtgtgccgggcctggcgcacaaggcctatgatgtatgtactaatcgagttagcgtggggggttcaccgatctggaccgatacgccgactcaatggacaaaattagatgtggaaggaggtactgagttaaaggagaagatcgacttaggattaccttcgtgtgcaacggacgcttatttgcacaaccatgtcgatatgaaattgctcaaggaagcaggggtgactcccggtagcctgcgcgcattgatgttaaaggcatcatacaagccgcggggaataaaggggtcatcggaactacgtttccgtgaggtggtgtgtccgccaacagttgttcagggcttgatcactgtgcgctattttcccaagcgtgtagtgactcagcactcagcgactaaagtcttagagggtttgatttcagggattgattggagagttctcgtgtctcggctacgtggcacagacagctcctatctctcggtaacgggtaaaagcgaatggccagtcggatgtgatggaaacgtcacgtattctgactgcatggcattgcgcaacaccctgacgaggccaacacttgtcaaaacaatcttcaaagtaaatgtgtagttcaacttttctcaaggataaagagaggacagatggttctaaacctagca

SEQ ID NO: 8 - DNA, 4939 bp, Unknown
  Diatom colony associated dsRNA virus 6
tgaaataactgtcattgctgtctctcttagacgacggtgcggttattctgtcaccgattatcaatcttaggtgccgggccttctatgttacgacaggggtattggttgattgaaccgcagagagggaaaggcctagaagggttacacgccataattctaggttggaacctcccatggctatgcgatagtggtagcgctactaccagggggggtctagagccacgaatgacacggagttggctgcagtcggcacatcaacccaacttatgttggcggggtgtgtttggttgtagggacattggctgagaggccgcgcgcatgggtgtaaaaaagatgggtcgcctgagagggctcgtcgcccggacatgcgtttacgctctttaccaggtttagaagcttggaccattgccataaatgtataacaccatccgatagagttttagcgcgcatcaagtagtcatgcttttagggaatttgcctacccggaagtttctctcttccgagcgtttcaaagcgatggggaagaccccgttcaagcagcgtttgtggttgaagtctacccacacggttttctctgattttggtagcggtcgccgcggaggatcagctcccgtgtggtacggtttggaggtggacagcaggcctgaagcggcgcgccccagcgcgtcgttgactgtggaccccctcgtgttgccagtcgggacccagtccctcactagcgtcgtcggagtcatgcgtgaggtgggagctcgtctggccgtagctgaaggaagtgagtgtgacttgaagtgtgacttcaggtccttggcctacatctgtggctttgtctcatcgtacacgtcggctgggctcgagcccgtcttctcgcaggctgcagctgctgtgcctagcaccagcaactacaccatgcaagcaggagactgtctcatgttcacgaggcccatcttcaagaacaacaacgagtttcgtaccctcctctacctttgcggagaggctgggaacgaggaggtgcacttcgcttgcgggtctgtgcccaaggcgggggctcgcttgaaaggtgagagcctcggagtcttcgccaaccgtgtgtatgccaatatcatggctgaaacgacgtctattgccgccgcagcgtctcacgctgaggcgaaattttcgggttcggtggcggccatgaaattgctaggacattcccaagaaggcggtgctatgcgcaagataatccgtactaggaattatccaaagtctgtcggattgatcaggacccacctgacatccattgttggtctcaacaccaacgaaaatttacatgaaaaagatttgttacgttatgaaatcgcgagtctgctcgaaggagctggcagggtcgcgcgttctgatcccaccaaatctaaaaacggtttgccctctatgtacaagccggacgagtttagcggtaagccaagttccatgagtggatttgagaactccgtctatgatttgttcgcgaattggcgcaaattggcggttgaggagctgtctctcgtaagtgacacaacgtctgattttcagtctttcagtgcttacttcgacagggacagcgacgaagaccactataaacacgccagggttgtccctttttactgggtcgaacctggtcccatctcgaccagtctgaactcgagcattcagatgctcggttgtcagggaaaaggagtgaccttagatatgattccgaacgctgtgggctacaagactgctgcttaccaggaacataaaggtgtcgcctttccaggtagtgtggtaaggctggtgtctagcggagggtatcacgctaggagtgcgggtatcaaccttctattcagcggtaggtatacgaaagctaacggtctctcccagttcaagcaagtcaccttcagtgcgagtggagtactcaacggcgacttagctatggcaggagacagttcgggtaccttggctgacaggcgctggcacacgttccacaatcccaccccaaaccccggggagtgtttcactgaccgtccgttcgcctgttcttacacctatagtggtgggttggaggagcccactctggaggagttcgtcaacggtaaggtcgagagcttgtttgggacgctacacttagcggacccagaggacaaggcttctaagtaccaccggtcagtgccggattacttagaggagacgtttgccagcaccaatgggttgttgggcttcttggaggacgcggccaatgtggtggacatggcgacgatcgtgtcacgcgaggttgtgccggtcgtccatcccgtcgagaggggtgtgtttgttgggccgagccaagtaggtgaggtcgagcaaaatgaaagggatacgggtgagcctgagccgggctccttgggtccttcagaagaaacagagactccatcttcagctgccgaggtacgaccagagatgtcgaccgagggcgctgaaggtggctcttaggctatgtgggcatacctcagtgcacgtattggaaagtgcgtgtcactaagggaggccctcgtagtactttccctagctgaacgcggttgcacggcgcgtcagttagtacatttaggcctaaacctgtgggatgtccccctgcaggtggaggttactgtgcaagacatattgtcttacatgttcgaagagctgcatgtggggcacaaaattgaagctcaatgtggaggaggatgtttggatctggatgttgcggacgataggaagatttaccctctgaagggtcacgttgcggctgagacgaaggtaaacgtgttcttcagggatgtttggaaggatgcaaagaagtacttccctgaggaagcggatgagtttaggaaactaagtggttgtacggctggaatgtacaacgaccaggccagtgcgtggttggtctggttttgtgcagtctggaagaaggataggtgggttgcagagtcacttttggtgaactggaaggatcaagagttcctcaagacgttgtcagaccttgttaagggcttaggagccacaagaacagaattaggttgctgtgttgctgagatgaaggtgctcgttgggcgtggagctaaggcactagatagagatgaggacgttaggtgtagaattgacaaggctgctttcgagcgcgagaagagctgtggcattggtgaagagatcaggccctatgttagggctgtgttgagagaagaaatgggtaggaatcctgcttggccatctaaggattcttactggaagaggcggtggctatacacaaaatcaggtgcgcacgctaggcgtgtggagagaattaagatgggcaggaagttagatctgccggagcggcctacaaggcgagagttcttcgagaacgtggaggagaatttgataggcttcggggaaccgtgcgcactggcaggtcagagtggcaagctggaacatgcttctgagagggcgatatattcttgcgactctgtccactatgccacttttgactacctgttgaagcctgtggaggcagtgtggcgcaacaagagctgcttgttggaccctggtgcaagacagaagtctgagctgtacggtgcactaggggctaagaaagaggtgagcctcatggttgattttgaggattacaatagccagcacacaaaggaagcgatgaagattgtcatagaggaagcgtgtcaaggtgccccccctgagatcttgcaatggtgtcttgactcaatcgacaacgagctcgtcttctggaaaggaatggacgggaaggataagatggcgcggactgtggggggtttgtttagcggtcacagggcgaccacgttcataaataccgtattgaactcagcgtacataaggtacgtatgcggtgtgcagagattagcggtcaaatcttaccatgcaggcgacgatgtttatttgtcagggacagcagataacatcgagagtgtgtttagtaaggttttggcttctagagttagagtcaacagatcgaaacagggtctggggactaaggtaggcgagttcctacgggttgcattcacagctgacggagctaggggttatcttgcgagatctatcgctagtcttgtcagcggcaactgggtaggagagacgagggcgtcagcagcggcggctgttcagaactacgctaatcagtcgtggacattagctgtccgctcaggggttagcaagctgcctatgttgctggtgtcgacagtgtgtagaagggtgccggagctagcacactacgcggctgatatctgcggattgcggatgtcagtaaacggaagtccagtgttcgactcacctgggtcaacactggcaattttgaaggttggagacaagaaggccaggaggtcgaaggtaggtatgggttaccactcatacgctacagatgactttttgaacaactatgtctcagaggaactgctcaatagagcaagagtagaaaggggtgcgctgaggaagctgatgctagaagtgtcatacaagcaagccggcgacgaactggagcctactccgaagctagagtggttcatagtacagtgtccgaaaaggtcattgtacagtgtgaatgttatgagatcattggatgtgagggcgcagaccagggacgagagccatatggcaaagttactgggctcgctagtaggcgggatcgactgggagaggatagtgcgtgcacttgtgggcgatgctagccctctggctagtaagctggacccagacacctggccagttacaaacgatggaaccttagacattacggaattgaacgcgtaccgacggaggatgctcaggcctctgtgcgtcaattctgcttaccctatcagggtttagaaagatttggtagctccaacacctaggcgcggggtacagactgtgcactttgtgcatggttcatgtgactgctaacctaggtactgagattgaataggttaccaagtctatgtgt

SEQ ID NO: 9 - DNA, 5327 bp, Unknown
  Diatom colony associated dsRNA virus 7
tgaatatgagcgagagcaccccataggtacccttctcatacaccaggtagtcctgggggtgacacttcgcctagctatgcaagagctttgaaagtgttcacctgagcacgcggcctcgtcagacaaggttagcgccgaaccccactagctaagttgatgctcaatcgtagtgtgtgtgttttctagcattcacgccgaaggttactgagctctgtaagattcacgtctgcggagtagtgattcaccgttaagtcgggatagcttcctgtttggaaacactcaggatcagggctaagaccccgtagaacagtagccgagtagtacaaactcaaagttagtcttgtcgagtctttcgcgcagtacaatcagggtaagaagccattggtaattgatggtggatcctatgaagttgtagctagctgagattctcatatatcttagttctagtaacaaaatcataggcgtgctgcacgaagcagaaggttttaagtgatattatcgctgatgtccgaagacataactgacgcccctctggttgtaccgctaggctcggcaagcactaactgcgtttcagctgctagtggggttcctgcgaaagcagacaccgacctccgccgttatacggcaaacttgcaaacctctgccaagttgcacggacatttggatgtcggcaacagggctatcgtttggaacgttgggcgtcgcggtggtgctggagctggtttggaggcccctggcgacgaggttagttgttacgagattggttttacgcctgttgagagccacgctgtggatgctcacggcatggcctcgaagtttagcgcctttccgagcaggtggagctttatggacttctccggtttgtgtgagcgcttgatgtgtgccatggcccacttcgcgaaccacggaaccttgaccacggctcagatccgcggaggaaaggagttgaacgtcgtggctttaggctcgttggtcaggccgatttctgctgggcgtggtgacttgtttctgggcgcagaggcaagctcgatcacgactccgggcattatctgtgcgatggcgaatgccatgtcaggctgtggtggtaggttggtcttagatgcggttgagttgcaggcaggtacgaactctgtacttgtcgaggaggcgtcggacgaggctttagcttacggttgcttctatgcttgggccctcctcatggcaaacttgaagcacaacaaagttggcagtcagggcgtttatgcgtcgactcgcggtgtgcacggcgggacgactgtgtacgggcacacggatgaagggtcgtacacgcgtgacgtgttgcgtaggagccgtttcggtgtgccttgcggggccgtgctcttgaagtaccctgacttcaccagctgtggagcgccgaagggaggtttggcgtcgtggcagcgtttcatcgatggtatcgccttgtccacggccgccgcggctcaggtctctgacccgctcgtggctgtcaacggcaagatgtacccgacgatcttctcgttcgaaggtcctgacgtggaggctggcctcaacttgaagggcacggacgagatggcgattagtcatggccgcagctacgcaagtaacgccactaggtttggggcgatctacttgaagagctgctgtgaccttttcggtgtggaggacaacgactcgcgctccctggcgcactttgctgcttgtgccaatgatttggtcggtgtggcgaagtctcatctgcgccactctaccgtcgccccgtacacgtggattgaaagtactggcctgattgacctggatgcggtcgggcgccctgcggtcgctgagggttacggtcccttgactgcgcctgggcgtgtcaaggagatgccgtacttcagcggctcgaccatggtctcgcagaatgtagtctgcagccacttggccgttgactggagggccgcacgcaagcacggactcttgcagcacctgaccctccatgcgcgtgatggcttggccaacatacgtttgaaacaactggacccgtctcgcatgacgttgtgcggcagccctattgatagcgatgccgggaagtctatgtcggacatgatgttagatggacatgatgtttccgatatgctgtggggtcgcgggcactctggagccatcgcaccagctgagatgttgtacactggtaaccgtgtcttagtacaggtaatgtgtgctagcctcggcgaggacggcgacgagttcacggagttgcacgcgcctactgctgaggacatgtcgggcgaggtgaggattacggtttccatgcctatgccgatctccaatgggaagctcaaagacaagaagactcgagtcagccgtgacaggtcgaaagctgcgaaggccctcaagcgagctcgtatcgcggttgggaacatcagcggcggttacgttgacgtggctgtctcgttcgttgacttttgcatcggtggcgaggagccgtcagccctctccgacacgccgggctcgaacgccactgctgaggcggctggcagcgtcgtctccagtactcctgcaattgcggaagtcactgtggcggccggagcaagggctggccctactgtaaggtggaattccactagtggacctggtttagccaggcacgacggcaggcactcgggtgcgtctaataccacccccggcgcagcgagcgcccaaaacgttgaaccgactcgtaacactgcagacgactccgagacccagcaagagactggcactgagagcgcagacactgttgcgggcgaggtagtctaggatggcctcacgggtgccaacactccaccctgtcgtcacgtgtgaccgaactgggtagggccggccaagccctactcaagcacattgctgacgacgacttgcgagctatgcaagtacccgtggggcaacaaattgtgtacgtccaagctttggcagagcaagggcgttgtgtgaaggctgctgccgttagtatccttcttagtgacgtgaccgtacaggtggacgtagggcagagtgaattcatgcgaatggttcacgagtcgtacagaacccagtgcggccacggcactgcgctgtgtggcacgcaaaagtgtaacggtccaagatgtagggtcttggaagctgagagaggagcccggggtgatgtcttcgaaaggaagagtcatccaggggctgtaaacaaggtcaacgtgtactggagtgacgcactcgttgactgtaagaagtactgcacacctgtctatagcgaggctatgaacaagagctggctattcgaagggctgtacgaggacagcgcaacagcttgcctgatgcaggctgcagggattgcacatgtgcacgacgattcggtctggcttgtgagacaaatgatggacgggtcgaagacatccaaaggttggagtacgattattaaatcgttagggctgaatggcagggcctggggagcaatgattgtcgagagctctgcattgttaggtcgaggtgtaggtgacgcaaacgtcgcagaggagaagagaatgcgttgcgacaggaagaaaagtaaggagatgaacgcgacgtggtatgaccctagcaaattacgtgaggcggtacgcaccatactcactgttgaactgggtaaccaggttattgagtacccggacatagatgagtggtggtccaggcgttggctgtggtgcgttaacggttctcacagcagagtgagggaacggatcaccggtgagcacgtggtggacgtgaaagggcagatacacagacgcgtgttcatggaaaacgttgaaaacgagccggttagcggatgggatggcaaggcgtactattctgctagcgagaagttggagaacgggaagtctaggtgtatcatagcactggacagtgtgagctactcggcgttcgagtacttcctcaagcccgtcgaaaaggcttggcgtggtgttaaggtgatactggacccgggcagctcggggcatattggcgtgcgcgagcggctggagaaagtgagcacaggggcagcggtgaacctgatgctggactacgacgccttcaacgagcaacatagcctagaagcgatggctatagtgtacgatgagctggcgaagtacgtgcacctggatgatacgctaaggaagaaactggtgtcgagtgtgtacaacggatacctggaggttgatggtgtcatgcgtttgatgctgggctcgttgtgctccggccaccgaggcacaactttcatcaactctgtgctgaacttggcgtacctgatggtcgccgactcggagttcttcaactcgcgctctgtgcacgtaggtgacgacatatatgtagcgtgtacgtcgtacgaggaggctgagaggatcttgctcaaggtaagagagacggacttgaggctgaatccgatgaaacagagcctggggcacacgacaaaggagtttttacgtgtggccacgagaggtgactgtagttatggctatctggccaggtcagtcgctgcatgcgtggaaggtaactgggtaggtgaacgtaggctgagcaaggtcgaaagcttgcagtcgatggtacagcatgcgtggactctgaggaaccggtctgttggcggttgtgcgcatttgatgttggtaagcgccatatgtaggtacactggtatgagcaggacacgggtcttgcagctagttcgcggcaccaccgctctaggttgcgggccctctatcagaagagacggaagggtagtgtcctatgaggtgaaagaagtggtggaagtggtgaatgatgctaggaccaggttgtggtcgaaagtgaaggaggcaggaggccagaagttcgcaactacgagctatatgctggaacacataacacctgaggaggttgtcgctttgcgcttagctcaaactgacgtcagtactgtaatgcttgaggcttcgtattcgaagtcgctagctgaagttagtgatgcttttgagaccgggacgttgagggtgaccgaacacagtaggtatgtggccagcggtagcgtcttgagtagcgagcttatacacgcgcaggttaatgtaggagtattcgaggggatgccgattatgaacctggtgaaaggtggtctgactgtcaggcagttggctgaggtgttgcggtttgcgggttatgatcccgggccggaccctatagtgactgcttttggaaattacgctgtcgggagactggtggaaggagttctaagttactccgacagtgtagcactatgtaggagaaccgactcagacacgatcgtttgtctgagacctatgtatgtgtaaggagattgtactgctgtgaagcaaagacaggggtatgatatagca

SEQ ID NO: 10 - DNA, 4660 bp, Unknown
  Diatom colony associated dsRNA virus 8
tgataacgtgccggcagggccgggcgttatcgacgggatggttctccatcctcggacgcgggttcatattatctaattgggactgattggggcgagtacttagcagtatagcatatatccaagagtgagaagcttagggtggaaactcgggtataggcgccgcgtggttaagatggcagcacgggcggtgaaaatccgctgtgaacagcgtaaaacccatatagcgcggtacgaggggtgcgttaaattcctcatttcccgacgaagtccagtggtagcgacataaacagttgggtaacatgaatagtctaaaagtgatgagcgacggagaggtgacgacctttcctgtcgaggtgagggtgcgtgtagacgcaactcacggcgacggacagtttgccagggagacgcacgctgatgtggttttccaggtggagttgaagtcggaggaggagatggagttggaagtgactccggctaggggtggcctagccaggaccgcatcggatgcggtgaccacgctatccagtggtgttagggctgggattgctaatctagcgccttcgttctaccgccacgatctcagggcgatcacgttctatcttgggtacctgtcgtgccttgtcttggccaagaagcagtggccggatgagttgactagtattaaaggtgtgagccccctggcaagtggggtgggctccggagatctggtttacgagccacgaggaggtggtgcgagagaggtcatttatgtgttggctttggcagctaaggcggtggggtgcaaccgtctgtatgtgtacaacgagcagttctcaactgcctcgaaaccgaggtcgactgctcagagacgcagatacttgcacataaccttgaggacggtactggctgactctgcaagctgcggcctgtacggtgatcacgctatggcgtactaccgcggtctcaactgtggtatgactttgcggtcgcatacggacgaaggtggctgggttagaaaggctatggcaaaggcttcctacccagtcagtagtggtatcgttaagacggatccggacgagtaccccttgttgccacggttcaacacggtacagacgagtgagtccttgttcacgaacgagtgcgtgaacatgctcttggaggtgtcggcgttgatctccgacgctgacccggctcacgaggtgaacgtagctagtttggcgtacaaccggtacatggataagaacggtaacgtgttggacggtgatgtcgaggcggctcactctcggccctctgcctacgatgatgtggaaggtgttctccaccaaatggagaactacgctgttaagcacttgaacatcatccacgcggatgctccgagtgagggctgccacggttccttgcgtcgtggtactttcgagcactacctcgcagaggatagtgtggaccgacacttcgcaacgtacgagttcttgccgtacgcgttcgtggatgccccagtcttactggcacacgagtcgtgtgggaaactggagggaccgaaagcaggtactactagggtggtggatctattccctagtgatagtcgagtcatgccgcaagatgtacaaggcgtcacacgcagtgggaagcactatgctcacaagttgttttacgactacaaggattgtagtctgcgtggcatgggcgcgttttacttactggcgccagcgtggaacggtggcagggataagggtctgcatgcgatgaagttctacagccgagagagagtgtcggattgtgtgaccatgatgcgcaagtcggaggataacttactgggtgagatgtgttgggtcaggacgagttgtccagtgccggccccgggcgagggtcgaaactggggaggcaaggtggcgttaggataccacggaggcctcgggcgccacatcagaacggcgtcggacactaaggtctatttgcacacgggtgcagcggagatgcgcagtgtcaagcggtttaatactactgtatgcaggatggacaggaatattaattcgcattatcgtaagtacttgaacgattttgatttggagcagagtgagatgattgacgattttctcttctccgctgctgtcagcagcacccctcgcaacgtagtaggagtacgcgagggcaccggagttaggcctgacgagccaggagtctacgtggacagtgagcccttggaggctgacacaagacacgtagcctcggttgctaccgtgacagagacccccacgcccagagaggccgagagtggagatggcactgtcgacggcggcgatgggtcataagctgttgattgcctgtcgactacttgaggaagctaggcgtagattcgacggggcaacagttgtgagactagctcaaacggtgtggtgtgtgcccatgcaggtgcgcttgacaagtcctcaagtcaaggagtacgtgcgggggtacatacgtggtgcagacaagatcagtgtcgtggcacagaacgcgaagaaggtggaaaagtggttggagttgcggactgatgaccgtaatctctttcctcttaaagatcacgtgggagcggcgacgaaagtcaacatgtttctcggcgacgtggtcaatgatgctatggacttagttggatttaattttgtgagagatataatggttgtagcgttgagtcggaacgctaccaacgaccaggctacgggattgttagtctgggcgtgcgctctccatgagcaggggctgcctgctgtggagttgtgttcactgagctgggcggcgatgaaacagctgagtgaagaggtgaaggcgctgggtgtggctggctcaccccacctacacctgttggcagagtgccaggccttggaaggtcgtggtgtaaaagcggtggattgggacgacgagatggacaagaggttgaattcattcaacaggaaaggtatgttggctcctttctccatagaggagctgactccggtcgttcggcggatcgtgaacgaggagaggaggacctttgaggttcctaagtgggagaaggcttggcgtcggcgtttcgctacgaccaagggtggatcccacaacagcatgggccgccgaaaaggaaaggacctcccggatggccagcttaacaagcgtaactatgcagaggcggtagatttcgctgaagtgggggctgtaccggcacaaggattggtatcggtgtccgaaaagctagagcacggaaagacacgggctatatattctctgaattcagagaactatttccgttttgacgcacccgctagggctctagaatcaggatggcggaaccaccgagcggtactgcaaccatcacggggagcggaaagtgttacgatagagaagcgagcaaagaatctgaggaagttcaagataatgtttgattatgctgatttcaactcggctcacactttggaagcccaaaaattgtgcgtgagagagttgttcgcaggtatggatgcggagtggttgaagtggttagaggacagttttgataacacttggataaaggatccaaggaccgggaagatggttaagatgcagggcacgttgtgttccggacacaggttaacaacgatcatcaatacgatattgaacgcggcgtatgtgaggttagttttgggtgagtcgttgtacaactccatctggatacaacacgttggtgatgacgtcgtggcttcgaccgacgatgcatgggcagcttccgaatgtatggaaaggatgctgaagtccggtttgaacttgcagccccagaaacaggcgttcggaactgtatgcgctgagttcttgcggatctcatttgaaaaggatgtcgcagtcggatattttccaaggtccattgccagcgctgtctcgggttcgtgggtgagcctgagggatttggattacggcgagtatttggagagtgtggctggtttgatttggacttggcgacagcggagtcagagtgtgagcattgtagagttgtggtgtagtactctagaacgcaggctcaagctgacacgcagggaggcgatgggtgtatgtcaaggcaatacatcactcaatagctctcccgtatggggatatggtcgacagtcggctaacaagctgactatcaacttgatcagtggaaggaagcgtaggcctagagtggttaggggcgttacacttccacgactcgctactggagattacgtcagctccagtgacgagtataatattttgcgggccctaggtgtacccgttggagtgttggatgaggtgatgctagaagcgtcatatggcaacatgttcacgcggccggagacagataagattactgtcaaggggtcaagcctaggtttcgttgcgacacgtatacgattgaagaatcgtgtcataatcacggagcagtcaagattgcacggtccgggctttttagctagtttgttaaaaggtaggatggacgacaagttttggcgtgcttacggtttagctatgaagaaagacgtgcgtgcctgtatgagtacatacagcacacgcgtgatgtgtttcggatttggtaccccgtatagtgaatcccgtgagttgcaaaaacactacgacagcggcgctaggtactaccaacaatacctcgccctgttttaatcttatataggacggtacactttacgtactggaacaaaatggatatatttcattagatgca

SEQ ID NO: 11 - DNA, 4844 bp, Unknown
  Diatom colony associated dsRNA virus 9 genome type A
tgaaaaaagagtgagttttacccgctctaagcacgaaagtgcatcctgctaatgcaatatgcaggggtcatcctattgtagtgttaggggggctaggttccaaaggaacagacatagtggacggctggcatagcgacgcgtcggtttcttgcttgtcaggcaagcgtatccgtttcccttcagacctggatctggggaatggcggtgctcccggctaaaccgcgccttacggggctggtgacgtgtaaaaactaaggacctaggttggctactacgttacgggagaaatagacgaaactatcggaacacgtctgtcatagatttttcaccagagtgcatcaatttattactgagctagtttccggaaactatgttattgccttttttacctaaccaaaaagttctccgtccaggtgctttcaagcttgtactcggtacagacaagaagcgtttgactttggcttgcacccattccgccgtcatggcgctcgggaagtctgacatccacggggtcgatgaagtccagtacctcattgacactaaggacagttggaataagccaaaccataacctgacggtggacaacagcgtacccccagttggggagcagtctgcatcttcggtcttagcgttttacaagtcgatcaatcctcgtcgcagtggaaacaccgtgctcgatggtaccttcacgttcgactttcgctctaccgagtatgttctgggtgctgtctctggccaggtgactgccaaagttacgaccgactttggtaacgtcatcttgccgaagatcgtcctactctctccgactcatacgctctcgtttagcgatcagccactcattaatcagatgatgtggtctaacgcaaacgaatatgtgaccttgctcactttgctgggtgctagtggtgctcgctccgtggccgttcctggtgacactgttcctcgtaaggggaagaagttgacaggactggccttggggtcttacgtgctccgcatccacgctgtgatcctgagcatggctaacagtacgtcttgtacagctaaccatgatcaggctttctttgaggggcagacttcggtcttgcgtctcaatgcccataccgacgagggcggctttgtccgcggcccattgggcaagaagatgtacccggctccccgtggtgcacttcttcctggtaccgcggagatttcggggttgagcactgttaacagtgttcgaccttctgaagtagctgtctggtcaatcgccaacttcctggaaggttgtggacgtctctcgcgagccgacccttccaacgtcgttggtgtcccaaccattatggagaacgaggacggtctcgacaagccatcctcttaccccggccttgaacagggcttttatgatttgatgaagaattggaggcttctttgtgctgaggaacgcggatatgtcgcaacggcttatccagatggatcctcctcccgtccctatttcgacactgacgcgtcggataggcacctgggtgcgccacagattgtaccattcttcttcgttgaaccaagcggtatctctaccgttaagaaatcggccgtcactatgcctgcggtgcagggtagcggaggttcgctgccttttttgaaggacgctaaggtcataaagacgaaggcgtactctgagtacaaaggtagagtcggaacaggaagtaaagtctttttgtacatgcctaaggggcatcatgctcgtgagaacggcttgcattacatcttttcttctaggtaccgcaaggagaacgggttatcgcagttcgaggccgtcacggcgcactccttgggtgtcgtggccaaggattacgccatggccgacaacgagacggaccttttaagcgagaagaggtgggagactcctcacaattgtctgcccaacccggctgagctttacaccgaaaggcgtgcgtgttttcgttacacgtactctggcgcacgttacgaacccacagctgaggacttcgagcgtggagaggttgattttaccatatcccctctctacattccaaagaagttggacgggtccacgaaggccatccataaggatgttcctgaccatttgcttgagatggtgaggaacacgcatttgaatcgtaagctcggattcggagctgaagaggatgagttcgaggagggctatgaggcctttttggagttcgggcctaacccagtgcccttagctgttgaccccggcgccttaaccccggctgctggtgagttggtccccgaaatagctaatgaagaagacatcgacccctccgagacggtggaagatgaggagatagaaatcgtccttgaccagagtggcggtttgatacgtccaggagttgagtcgcagtcgctgagtgccgaaattgagcacgatacagcatatgatgcggccaactccgtctctggttagtcagctacgcaagcgtaagggtgccaacctccccttacgcgaagcgctgactgtgcagaggctggcggatgaatttttggaagttggagaagctcttgagttgagccaatccacgtacaaggtcccaatccaaaattcaatcgatactaaaagtattatagggtccttcctcagtgttgaagtagagaatctggagttgccagatcctgccatcgctccttcactgttggatagtaaagatgacagggatgtgttccccctaaaggagaatccgcaggccaagacaaaggtcaatgtgttcttcagggatgtgtggactagtataaagaaatactttccgagacaagctacttttttgtcgaagaatgtagatctgttactgggtatgaacaatgacgaggcttcggcctgggtcatttggtttacgggggtctccgagatagacttctgggcagcaagagagttgctgaagatagctaaagattacgaaaggttgtccgagttatctgatttactgaagacgagcggtcgaggtgactgtttgttagggaggtgttgttttgagatgcgcgttttagcggggagaggtgccagccccccggacccggcgaaggacgtgcggacgaggatagacaagaaggcctttgaggcggagaagagctgtggtgtgggctctgaaattcgtaagtacgtgcgggaggttttgaacaacgaaatggtgaggaggccgaattgggagacaacgaaatcgtattggaagaagaggtggctctatacgaaatcggggtctcacgctcggaggatagagaagcacatgttcgacaagaagttggatctgcctccgcagccaaccaggcgagagtttagtgaggctgtgaaggagtgtgtggtggcgaccgggttgccttcgacacacgcaggccagagttggaagctggaacacttcaagacaagggcgatttactcaggggacacgcggagttacttcacctttgattacttgttgagaccggttgaggctgtgtgggcaaacaagacgtgtttgcttgaccctggcaacaggggtcagatggagatgttctccgagctatcaagccacggggacgtcaatttcatgttggactttgaagatttcaatgctcagcatacgaaggaagcgatgaaggtcgtgattgaagaggcgtgtgctggcgcaccagaggatgtggtcaaatgggcgttggagagtttcgacaatgagtttgtgtactggatggaggatggtgtcgagaagtgtgctctgacaatcggcggtctgttcagtgggcatagggccactacgttccttaacacggtgttgaacgaagcgtactgtaggatggcgatgggagatgtctacagacgcttgaaatgcaagcacgctggcgatgacgtcatagtccaggggacggatgtagacatcgatattgcggtatcgaggttcatggagagcccattcagggccaacccaagcaagcaggggcttgggagaatgtgtggtgagtttttgagaacgtctttcaccaaaaaggaagctggcggttattttgccagggcagtgagtagtttggtgagcgggaactgggtttcagacagcactaacacggagttggaggcggcgcagaactacgcgtctatgagctggactcttgctgtaagatctcaggtcttgaacataggcgcggtcctgacggacactatattaaggagggttccgtcgatcgcgccgtatgcattcgccgtggcgacatgcggggtgtcagtaggagggacaccggtgtttggatcagcgaagggtcaagttttgatgcttgacatagtgagtaagagtattagagagagggaagtggatttctctaagtcttacgctacggatgatttcatcaattcacagattgatgagaaaatgttggaaatggcagggattactcgagctcaattgcgaagggcgatgctagaagcatcaacaaagccacgcattgagtcgaacgatgaatctcctgctggggtgctgtgcctgaaggcacccgtcgccgacatggtggatattgtggtcgcgaagagtaacgttgtcaggcaggcaacgaatgatactatcgcggcgcagaaagtactgagctccctatacgggagaatagactgggataaggtgttcagtgtgattactggaaatagagcaccgctcctacccgaactgtcacaggtcacttggcctgtggttaacagaggtaacatgagtttttccgagctcgcgaagaccaagaacgatttagtcaggtctgcgtgtgtaacgacgatgtatcccattttggtctagggcattaccctcgtagttctacctacgtcaggcaaagtagagtgctaacttagttagcgagataagatgaaaaacgtctagtgt

SEQ ID NO: 12 - DNA, 4845 bp, Unknown
  Diatom colony associated dsRNA virus 9 genome type B
tgaaaaaagagtgagttttacccgctctaagcacgaaagtgcatcctgctaatgcaatatgcaggggtcatcctattgtagtgttaggggggctaggttccaaaggaacagacatagtggaaggctggcatagcgacgcgtcggtttcttgcttgtcaggcaagcgtatccgtttccttacagactgagatctgaggaaaggcggtgctcccggctaaaccgcgcctcacggggctggtgacgtgtaaaaactaaggacctaggttggctactacgttacgggagaaattgacaaaactatcggaacacgtctgtcataaatttttcaccagagtgtattaatctattactgagctagtttccggaaactatgttattgccttttttacctaaccaaaaagttctccgtccaggtgccttcaagcttgtactcggtacagacaagaagcgtttgactttggcttgcacccattctgccgtcatggcacttgggaagtctgacatccatggtgtggacgaggtccagtatctcatcgacaccaaggacagttgggacaagccgaaccataacttgacggttgacaacagcgtacccccagttggtgagcagtccgcatcctcggttcttgcgttttataagtcgatcaaccctcgtcgcagtggaaacactgtcctcgacggtaacttcacgttcgactttcgctctactgagtatgttttgggcgctgtctccagccaggtgaccgccaaaattgagaccaattttgaccgcgtcatcttgccgaagatcgtcctgctctctccgactcatacgctctcgtttagtgaccaaccactcatcaatcagatgatgtggtcgaacgcaaacgaatatgtgacccttcttactttgttgggtgcgagtggtgccggttccgtggccgtcccaggtgacactgttcctcgtaaggggaagaagttgactgggttggccttaggatcctatgtacttcgcattcatgctgtgatcctgagtatggccaacagtacatcttgtacagccaaccatgatcaggctttttttgaggggcagacttcggtcctgcgtctcaattctcatactgatgagggtggctttgtccgcggaccgttgagcaagaagatgtatcccgctcctcgcggcgcgcttctcccaggtactgccgaaatttcgggactgagcaccgttaacagtgtccgtccctctgaggtggctgtctggacgatcgccaacttcttggaaggttgcggacgcctctcgagggccgacccttccaatacagtgggcgtcccaactattatggagaacgaggatggtcttgacaagccatcttcttaccctggcctcgaacagggtttttacgatttgatgaagaattggaggcttctctgtgctgatgaacgcggatatgtcgctacggcttatcccgatggatcatcctcccgtccctacttcgatgctgacgcgtcggataggcacctgggtgcgccacaggttgtaccattcttctttgttgagccgagcggtatctctaccgtcaaaaaatcggctgtcaccatgcctgcagtgcagggcagcggaggcacactgcccttcatgaaagatgtcaaggttataaagaccaaggcatactctgagtacaagggcagagtcggtaccgggagcaaagtcttcttgtacatgccaaaagggcatcatgcccgagagaacggtgtgcactatatcttttcgtccaagtaccgcaaagagaacggcttgtcgcagttcgaagccgtcacggcaccctctttgggtgtggtgactaaggactacgccatggctgacaatgacaccgacctcttgagtgaaaagcgatgggagacgccccacaactgtttgccgaatccagcagagctttataccgaaaggcgtgcatgcttccgctacacgtattcgggtgcccgttatgaacccacagctgaagatttcgaacgtggagaggtggatttcactatctcacctctctacatacctaagaagttggacggctctacaaaggctatccataaggacgttccagaccatctgcttgagatggtcaggaacacgcacttgaaccgcaaactcgggttcggagcagaagaggacgagtttgaggagggctatgaggctttcttagagttcggtccgaaccctgtgcctcttgccgttgatcctggtgccttgaccccggctgcaggcgagctagttcctgagatcgccaacaccgaagatgttgatccgcatgagacgttggaagaggaggagacagagatcgttctcgatcaaagtggcggattgatacgcccaggagttgagtcgcaatcgctgagtgccgaaattgagcacgatgcagcatacgatgcggccaactccgtctctggttagtcagctacgcaagcgtaagggtgccaacctccccttacgcgaagcgctgactgtgcagaggctggcggatgaattcttggaagttggagaggctctagagttgagccaatccacgtataaggtcccaatccagaattcaatcgataccaagagtattatagggtccttcctcagtgttgaagtagaaaatctggaattgccagatcctgccatcgctccttcactgttggatagtaaagatgatagggatgtgttccccctgaaggagaacccacaggccaaaaccaaggtcaatgtgttctttagggatgtgtggaccagcatgaagaagtactttccgagacaggctacctttctgtcgaagaacgtcgagcttttgctgggtatgaacaatgacgaggcctcggcctgggtcatttggtttgcgggagtctctgagattgacttctgggcagcaagagagttgctgaagatagcccgagactatgacaaactgtcagagttgtcggacttgttgaagacgagcggtcgaggtgactgtttgttggggaggtgttgcttcgagatgcgtgtcttagcaggaaggggtgctagccctccagatcctgcgaaggacgtgcgcacgaggatagataagaaagctttcgaggcagagaaaagctgcggtgttggctcggagattcgtaagtatgtacgagaggttctgaacaacgagatggtgaggaggccgaactgggaaactacaaagtcgtactggaagaagaggtggctttacacgaaatcaggttctcacgctcggaggatagagaagcacatgtttgataaaaagttggatttacctccgcagcctaccagacgtgagtttagtgaggctgtgaaggagtgcgttgtggcaactgggttaccttcaacgcatgcggggcagagttggaaattggagcatttcaagacgcgagcaatttactcgggtgatacccgcagctactttactttcgactatttgttaaggccggttgaggctgtgtgggcgaacaagacctgtttgctcgatccaggcaacagaggccagatggagatgttttcagagctgtcccgccatggggacgttaatttcatgctggactttgaagatttcaatgctcagcacaccaaggaggcgatgaaggtcgtcattgaggaggcgtgcgctggcgcgccagaagaggtggtcaaatgggcgttggagagttttgacaatgagtatgtgtactggttggaggacggtgtcgagaggtgtgcccttacgatcggaggtctgttcagcgggcacagggcgaccacgttcctaaacacggtccttaatgaggcgtactgtaggatggcgatgggggatgtttatgagcgtctaaagtgtaagcacgctggggacgacgtgatcgtccagggaactgacaccgacatagacattgcggtctctaggttcatggaaagcccattcagggcgaatccgagtaagcagggactcgggcggatgtgtggtgaatttttgagaacgtctttcactaagaaggaagctggcggctactttgctagggcagtcagcagtctggtgagtggaaattgggtttcggatagcaccaacactgagttggaggcggcgcagaactatgcgtcgatgagctggactcttgccgtaaggtcacaggtccagaatataggtgcggtcttgacggacaccatactgaggagagtgccttcgatcgcgccgtacgcgtttgctgtggcaacgtgcggagtatcagtaggagggacccctgtgtttgggtctgcgaaaggtcaggttttaatgcttgacatagtaagtaagagtgtaagagaaagggaagtggatttctccaagtcttacgcgacggatgatttcatcaattcacaaattgatgagaagatgttggaaatggcggggattactcgagctcaattgcgaagggcgatgctggaagcatcaacaaagccacgcattgagtcgaacgatgaatctcctgctggggtgctttgcctgaaggcacccgtcgccgacatggtggatattgtggttgcgaaaagtaacgttgtccgacaggcaacgaatgatacgattgcggcacagaaagtattaagctctctttatgggagaatagactgggataaggtgttcagtgtgatcactggaaatagagcaccactcctacccgagctatcacaggtcacctggcctgtggttaacagaggtaatatgagtttttccgagctcgcgaagaccaagaacgacttagtcaggtctgcgtgtgtaacgacgatgtatcccattttggtctagggcattaccctcgtagttctacctacgtcaggcaaagtagagtgctaactccgttagcaagataagacgaaaaacgtctagtgta

SEQ ID NO: 13 - DNA, 5082 bp, Unknown
  Diatom colony associated dsRNA virus 10
tgataaacatggttatcgacagctgtcatagtcttgtttatactctgcacttgctatcctgatttatcagtgtttgcagagcctggctagtgtcgcatgtgagccgccagaatgctattgggtgcttcggtacgccatcgggccctggtcgtgcaagaccaccacagaagggatatatacatacgcacccacgggtcgaggagggtaagagctagtaatgggctctcctaagatacgtaacctcaggtagtgcgatattttaggataggaagtacacagttattgatcatgccggaaggcgaagcagttagggccgatacgatcacgggattgatctccaacaccatcgatactgtcgatgatgggatggagcgtcatgtcgcgaggtacaggtcggtcttgactactcaggcgaagattgcgggcatcaacgaaccatcagcgaagagtacgatttacaacgtgaactgtactccggcttctcagggtatcaaccttgtgactgatatgtcgattggtgctcgctcgacgctcgctgttgagttgcaggaggcgatcaagagcgagattaggaacgaggcgaacaacgctaacgcgttgagaggtggttgggactatgtggagctggcaggagtagtggctgttctcggaagcgggttagcttattacaggtttcacaagaagttgacccaggaggtcttgtcgggtggtaccgagcttaagctcgagagtgctcgctcgactactaggcccatctctcccagagatggtgcggtcttcctcggcgagtacagcgataggcaggcgtcgccatgtgtgattgcggcgatggtgggtgccgtttcgggtgctggtggaacactcttcaccaaggatgtggctgttaacccagccaacaacgcgaaggtgattccagacgcgagtggaaaggcgcttgcgactgggtgttacgatgcacttgtattgctggctaagaactacaacgcgaatggcgctggtgctgtgttcgcattcgcgttgatagttggcttgcatagggttggaactgttgaaggccacaccgatgaggggggctttatgcgtgagttgttgaggcgtgtccagttcccagctccgtacggcgcggtttcgttgggccctggagagttttctggtctcccggacccgactagaggtgtcggaggttttgacaggttggttgacagtctgctcctgcagagtgctggccttgtcgccgattgcgacccattggttgagagttttggcaatttgtacccgaccaccctggtgagtgagtatgagtggtcgaacggcgagaagcaggcttacgcgggtttgccagctgaacgtaaggcgaggattcttggtatggacggagacgcgcttgagtgcgcttctcagttgcgatcgaacttcagggagtttagcaccgcgtatgtctctcagctccccaggatgtttggtacgggaggctgtgagcgcattgtcagcctcgctctagaaggtgagtttatgtattcgcgcggtcatgtcttccgtcatttgaagatgaagaccgctaacccttactattggatcgagcccactggagtggtcaggctcgacaccagtcatcttccagctgtcagagagggctacggaacgctctgtcgtgtgaacgagccgactgaacgtccagctttcgatgggatcacgaaggtcggagaagcggcgcactacggtgcgtatgaagttgagtgggtcagtgcgaggaagcatgcgatgcttcagcatctgaccttgaacaaggacgacgggctggcgcatatcaagattaggcgtgtcccaaaggatagattgactgggctcggagtaggtgcgattgggcggcgtgacgagtctctcgagaacaagatcgagcatgagcgcggagctgaagagtacctttggggacgcggccacagtgctatgattgcgccaggcgagctcaatctggttcgcggaaagatcgggtttatcgttgagcgttatagcgagcatccgacggaccgtcgccggatcacggtcaatcacgcgccacttgaagatgagatggaccagaaagttacgttctctgtcttgcctttgatggctctcggttggggcgacaaaggcaatgaaggtgtggctagacgtgtcgagagagacaaggcgaacgatgctttgagcgcatgccgcgataggagcatgccttatttcaacgtgtccttgctaatgcctaaaggattggcgtcggacggtgatctggacgaagggcataccgcaaaggctgatgcaaaggtaagtgttccagaagacgaaggacaggtcggtttgaaggatggcgttactcagcaacgcgaagggaaagcaggtctacacgtgcttccacctttagatcgatcggcaacaggaagaaacaggtcgggcgctccgaactacccacaaccagatactagtgaggcaaaggaggcgcccgacgcggcctaatgtcgtcaattgaggctcgcatcaacgagctaggcagcctagggactgctctagccaagagattgagcgagccgatgatgacaaccttcccgagtaaaccggtagatgaacaggtctacgatatttacacagtacagcttaaggacccggttaaagctgcagcaatgtcgatgttattgtgtaagtacccagttcaggtagatattaatgtctcagacattattgatctgttgccagtaggcgaattcgtagggaaaatgaaggaggagcatggtgattttaggtttatggaaaacggtagaacaacgctgccgacaaaggcgcaccctggagctacaaacaaagtgaacgtctacttctccaacctgctacaggcgctgagggaggagaagccaggcgtgttacgttggttgctggctaaccagcacttgttttatggtctgcacgacgattcggcaagtgcgctgttgttagctggggagatgacgagctctgtattcgctcgatcgtatgagttgtattcgtatctgatacacaatccagacgatgcttcggcattgaatgttgtgatcaaatctctcggactcaattctaagcgtgagggggcaatgttgtgtgagtcaaagtgtttgcagggccggagtgtagagcccgtgtcgaaggcgaaggaggtagattatcgcataagtaagaggcgtgcgaggaaaaagacggttagactagaccgtgataggttgtatcagtgtatcgttgacgttatcagcagcgagttgccgcgcggaggggtaaactttgctgatcctgacgatcattgggatcgtaggtggttgtggtgtgtgaatggtgcacacagcagcgcgctctcgaagttcaagccacagtacgtggtcgacttttcgaaacgtatgcacaggaaagtttttgcagaaaacatcgcgtcttgccctatccaggcgtgggattcggtgtgttacttcgtgctctcgactaagttagagttagggaaagcgagggcgatcttcggaggcgactcagtatcatacttttgtttcgaccacttgctcaaaccaatcgaggatgcttggcggaataagcgtgtgaggttagacccagggaaaggcggcgtagttggcgtggtagatgaaatcaggaagctgggaggcgaaggatggaacgtgatgctggattatgacgacttcaatagtcagcacagtctggagtcccagaagctggtgatacaggcagctgtagaggtgtccgggtatgacagagtcttgggagcggcgctcattgcgagcttcgacaagagcttcatcgtggagggcgacaaggcctttaagttggagggtactttgatgagcggtcacagggcgactacattcatcaacagcgtgctgaatatggcctacatcttgtatgcttatcctcagttgtgggagatgaaaagcctgcacgttggggacgatgtgtacatcagcgctcgtgacgtgagggaggctatcgctgtcctcgaccgggtacagagcgtaggagtgagaatgaacccggttaagcagagcgttggcacatcaacggcagagttcctgaggatcgcgatgggaaagagaggagcttgcgggtacctgtgcaggtcgatcggttctgtcattagtggcaattgggtgagcgagaacaagcttaacccgagagaagcacttaacactatgatacaggccggttggacgttgagaatgcgcggaggtgtgaaagtgggctggctgttgcgtagggacatggccagagtgacgaaccttaagcataagatatgtgaggatttaattgatggagttgcatctgttgacggttcaccggtgcaggtgtcccaacggtacaacaagagttatacagcggagctcgtggacgatgaagagccgctggatgttaggatgtttggaggtaggagttacgctactgaagcgtatctgtctaagtgtactacgcctgttgaggtcagagcactagagttagcgggaggcgatgtcaaagacatgatggtacggtcttcatatacgaagacgctcatcagctatgatgtcgtgcggaccccatcactaactctgagggcgactggacaaaacaggcaaggcactgaggctgtatacgtggaaagtttggtgggtactgttgaggttggaggcgagctgacgaagtatccgctagttaacttcgtgcgagatatgttgagtgaaagggattgtgttgcccttcttgggatgataggcatccgggctgagaggagcgaagcaaaggagttggcattcggaagtgaggtagacgtaccgaccttcgtcaacggggctttaccattcagtgacgctcgcaccctaagaggtgtggcagggggcagagtcatgatgactcgttacccgatcaggttctagcagctgcagagcggggaaccttgttacgagctactagctcgtactgaacagttgtagccagcttgcactatatgtgggcttcaacagtggaccaagaccgtgcggaactaagttcgcggcacgaagggcacttaggtgccagtatgagtaggccccggaaggggtcaattaagca

SEQ ID NO: 14 - DNA, 5160 bp, Unknown
  Diatom colony associated dsRNA virus 11
tgataaaatctcaatgtttcacgatattggctcaagattttatgtagcagctacaacatgcttgaatggtgttgtaagaaagacatgtggtaccacgccatctacaaaatgtgaactgtcaatgatcgttttagtttaatgcggccgcgcagaccttgatgaggcaccggtaacggtggtatgctcaaatactagggggcccgagattccgaaatactttacgcacttggtcacacgctctgtgaaaggcatccttgttaatggaggacttgctttccgatcagaggtcgcccgttcaggtcacgatatttgacagaaagttaaaaagctagcctaggcaaggcccaacttgccatgttatttgacattaatttgacaaagattgcaggtttgattgcccgtgctgtcgacgatcagttgacatcgggcaatcatttcttgagatacggttgtactttgacaagcacatgcaacgtcggaggtgtaactgaggtctcgaacaagttcattgagttccagattgggaaggtggacacgtcaggtgggatagtcctcgaggatagggctcattcagcggtgaggtgtgaggttgtgatgactgacgggttgttggaggagactcgtgcttacgcgaacaaggacaatgcgttgagtggtgattttggcgtctttgaccacagtgggacggtcgctttgttggctagagccgtagctaagttccgcttcgagggtgtcctaggtatcgatgacctcctcggtagcgaaaccttctcttatgaagctttgcgtgctcagacgaggcaagtagctgcttcgggtcacgccacggtactcccggcaggtgcggactctttttcgtcaccgaacgtgagtgctgcaattgtaggagcggtctcgggcctaggtggtacagtttattcccatttagttggagtgaatgctgacaccaacactgcccgtatcccctcctgttccgggagagagttggccttgggatgttacgacgccctcaacattttagcgaagcagtacgacgcttgtggtgctggtgaggtgtttgcttgggcccacactgtggggttaatccaaggaggcaccgtagttagcgggacggatgaaggtggaatcatccgtgacattttcaggtctgtgcgctttggggtcccttacggtcctatctgtgttaagatagatgccgtaagcccgttgcccacacctcgtgtaaagaacggcttcgccaagtatgtggatggtactttactacagtgcgctggcgcggttgcgatttgcgaccctctcgtaactttcgagggggaatcgtacgtcaccactttaaccagttcgtacaagatgactgatgaagagaaacagaagtatgacgctgacttgcttgctgatggaaagagggacccaaacgagggtgttgatggtgatgccatctcactcatgtccaagttacagatgagttttccgtcgttcatggctctctactccaaggcgttgggtaggatctatggtttggaaggaggtagtaatgtagttgtccagtccgcgttatcagcactgatgagtaacgttgggaaggtgaagcgtcaccttaggtacaagacagtcaacccttacttttggatcgaacctaccggttctactcgttttgacgttagcggcttcccggtgaccagtgccggtatcgggcgccttgccagcatcgacgcggaaggcacgaggcccgcgttttatggtgttgaggagagaggagataacggttttagtgcagcgtacaaagtgaagtggggctgtgcgaggaagcacggtatgttgcagcacctgaccgctcacgccgaggacggtcttgctaatataaagttgaggcaggtcaacagccacaagatttgtgggctgggtgttggtgctgtcggaagagagagagaaccgctcgagcagaagctaggtaattcgcgtggtcttgaggaatatttgtggcgtcgcggtacgagtagtgtgattgggccaggtgagattgtaaccccgggagcgcgcgtcgggttggtcatcaactataggcggctcggagatggagactcgcttaaggttgaagcgttgcacgcaccaactccgtctgagatgatgcaggctgtgacgtttagcgtttccgggttgcaggccatcggtgtcaagaagaatgggcctggtccaacggtgaaggcaatgcgtcagaaagatgtggcgagccgtgcccttgacaacgctcggtacgctgagtccaggctcgttgatttggatcttctgatgcctgtgtccacgcaagacgaggacttcgatgaggacaaggaggagcagacaggtggtccgccagttgaagttgcgaacccggattccgcggaggagaaagcaggtgaagaggtagctggggaggtgttgacgcctacagcggtgcatggtgccaatacggctcctagattagtcaacgacgcgaagggtgcagaccctagaagtggccaaaccaagatggttccacccggtactgcacctgtggggacttaatgtcccctgaagtcgcacgcaggatgaaagagttaggtggtattggtttgcgcctagcaacacacctgcgtgaagacgacattaaacaaaccaacttaagtggagaggcttggatgaggtacgtagagaggctggaagggagcggggcacgtttacgtgccgctgctgtttcgatgcttctcagcgattaccctatccaagtttcactcaaaggcccggagcttctgtctttgattgatttctccactttcgtaagtgaacaagaagctaaaagaaaaagagaaggatttgacgaaggatttgaattatacaaggatggtaaggatcaactgccactgaaggtgaacccaggcgcggtaaacaaggtgaatgtgtacttcagtacagttatgttgggattgaagaagaaggacaggaggtactatttgcatgtgttgacaaatggttatttgttgaacgggctgtacaacgattcagcatctgcggtgttgatgtatgcctgtttgactagggatattattcctgactcgttcaagttggcgtgttacatggcggccaacccgagcgaggcgaaggcgttgagtacggttattaagtcactaggatgtaattctacgagagtgggcgcatgtctggcggagatgaatgcgttacagggtagagatgtgggtgttgtgacttttgatgaagaggcaaggtatcggtgcgaccaagaggcagttaaagagaaaaacattaaggttgatgcgcacaaactgagagaggccgtgaagtatgtggtcaggaacgagttggcgggcagaaccgttaagttcgactctttggacgagcactgggacaagcggtggctgtggtgcgtgaatggagcgcattctggtgcactggtcaagcgcgaggctaagtgggcaacctcttttaccaagcgcatgcataggaaggtttttgcggaaaacataagctatgagcctgtgtctaggtggagcggagtatcatacttcactatgagtttgaaactcgagttaggtaagacgagagcgatatttggaggagacacggtttcatactttgctttcgaccacttgttatcgccgatcgagcgagcgtggggaggaaggagagtgattctaaaccctggcaaaggcgggaccgtcggagtcgtagacagggtgaggaagatgaagaggtcaggtgcttggagcgtgatgttggattatgatgattttaactcccaacacacgcttttggcgcaagcgattgtgattgatgcacttgttaaggagagtgggtacgacccagctttaggagcaaagttagtgtcatcgatctttgagcagcacattgtagaaggtgacgaagtgttgcggttgttgggtacgttgatgagtggacaccgggcaacaacgataatcaacagcatattgaactacgcatatctgctcgtagcgaacgaggatatcaagaacatggactccgttcatgttggcgatgacatattggtaatggccgataacgctgcccaggcgttccggttgcttgatagtgtcagaagttcaggtgtaaggatgaaccctcttaaacagagtgtaggagttaagacgagtgaatttttacgtgttgctgtaggtcctgttgaggcgtggggttacttggctagatctataggaagtatagtgtctggcaactgggttggagagacggctcttgatcccagagaagcattgagttcgattgtggcgtcagcgtggacgttaggcaatagagcccgtgctgaggtggggtacttactcaagtacgatctgaacagggtcacaggtattaaagtggacctgtgcgagaggatgttggacggacatgttagcctgaacgggtctccggtcagggggaacaagaacctggtggaggtagtgagagttgtgagcaatgaagaacacaaggagcaaggtgaagacatagttgatgtagtcaaacgatacggaggtaagaagtatgcaacgacggattacctgagtaatcacgtaacatatgtggagaggttagcgctgcagcttgttggtggagatgtaactgaaatgatggtacggtctagttattcaaagacgctcatcagtcgggacatcatctcatccgaaaagctggaactgaccactcagcacatacggttgcgggcgactcagtctgtcggctttgacagcctcgtttctcttgagaaagagaagccaggcagcttagcagcataccctctgatcggtttggtaagagacagactgtctgaggctcagattgtgcggttattgcgggtgattggcgacaatcgtccaggagaggtgtacgagaaggcgttcggcgccaaggaaaaggcagtgatatgcattagtggtagtgtcccttactcggatgcaatcatgtatggaaggcgtgcagaaggtaagaacatattcgtgaactataacattaacttttagttcgtatcttcttacaatgtctgtgcgcgcggtcagggtgtgccatacttgggtatggtgcgggcctggcatgccactataagtggtgcagtggtttcactgcggttggtaagaccaacaatatggtataggcccccctcggggggtacaagca

SEQ ID NO: 15 - DNA, 5941 bp, Unknown
  Diatom colony associated dsRNA virus 12
tgataaaaacgcaatgtttttatgccaaagagacaccagtcttagctgggcgaaggttcagtgcctggtgtttgtttgtcggtcttgtgcattactaagtgcccctgagatacacggaagcgacagtcaataatttagtagataggaactcgccaggtggaattagatagtcagatcccgagtcattgtaaatgagcgaaaaacaatggttgtaggagtgaagaatagtggccgtgataaaacacattaagtccaacagaaaccgattagagtatagctgtccagaggagaggcctcggtccaacataagaaacgtggggttatgatcttcgcactaatagaccgtagaagcggtactaagctcatacatacaccgatctcagtgtaatacacattacgagaacgacagacaaacacactaaaggccaaaacctatatcgctgatagctgacacagtcagactttagcattgcaagcatgcctgagatcaaagtcaggtttgatgaggagccagccgatggacagttggtatcgatccgtgaggttgatattgaggctgcaacggctgtcgcttccaggagggagattgttccggttcttgcctctgagaccggattgttgaggaaattgtcaaactatgcggtcaatgtcaatttgacagctgagcaccttgatcttaccggcaaagagccaaagatcacgctgacggccactgtcaatgcagttgttgctgagatgaacaagaaccctgtcttcgccgagaaagaaaaaatggttaaggcatgctttatgagcgtggcatgcccaaacactttttcgctctctgtggttaagggacatggtgtcatttacagcaatcccgcatgcaacactcctgagcacagtgtgcgtgggatgtggcgagagacgaaaggccaaactgctttcttgaacaacatctgttctcagaatgttgcaaagatgagtgcttgcgccgttcagatggcaaagtggttctatgaggcgtgcatcagcgcaccacttcatgggacccgcaaaccagttttggcccctatgcacatgcgcggacgtgatgaggagccaacgcacgagattacatgcgccttggcccctgacttgaaaggaaaacacggagttgaggtgattagtctcatctacaatgctcttgagagcaaggaagtgctagctgctgctggttttgacacgacggtaaaccacgtctggaattcagtccagaattgcggaccagtggttgtggctgaggacattttttgggaggcgtacaaggtgttgaagttttcgtgcggcgacgagcaggctgctaaaaagtacgactgtgagttcgccttggctgtagcttctgttgcttcgcttcacggaaacacagacgaaggagggatctggagaaatctgttcaaaaacatgcaggttgaaccaaaccgcatcgtagctgtgagcccatttaatgcatcgacctccgggtacaacgatatagacagtggaaccgtcattagtgcttgcgctaacttgcaaagcatcgtttctcgcgctttgagcgaagctaacattgctaagaggatgatggtgcttgagcctggatgcaccaatgaggactacctccgtgtgcaagcaactgtgatgaacgaaatctgtgaccatatggccgcggcgactgccatgggaccagaattctttgagcaacgattctgtgttgaggcacttgacccggccctgcgtgataggcattttgcacctggcgacagagccacaatcgtggcaaactatagtccctacttgagcacctatagcgtggatgacgtaggaaatgaaaaaggacgttttgagtatgataaggagagcacaatgcccttgaagtttagtggtgattttgcaatcgagaagtacattgacagaggaagggtatatgttttgattgacattagccaagcacgcagcttcagagacggtttgtgttttctcgacccaaagctaaacagaaataatccattaggtgaatgcattgtcaaaggcagaattgactcaagtggtaacttttttgaggacacgacactagttgatggtcaggtgcttaggagaggtgaaacccttggtgacaagctatggcgtgacaacggttgcctttttccgtcttacggtgacaccaacactacggaaagtggcaagatcatacttgaagcaagcggtttgccagagtgggcgtttggcgcatcgtatgaagtcaagatcacacgatatgctttttgcaccagaatgtcaggtgaagatgagaaaagtacgcgcaggatgaagtacgaatcaaaggtgcacaacagcagcaatgtcaagtatggcactaagccgcctgaaatcaaaaacgtggccgagtacttaagaaaagttaagaagcagagcattggcagaagcgaagcaagggttgctgagttggctagaaagaaactatacatggatgaaagaatcgatgagttatacggagagactattgaccggctcgtcgaagatagcgacaaagtgaatgctgcatcgttgggcaaagctgtggcaaaagttgtcctgcccgtttttgtggctgaggatgccatatcccaagtccatagtggagaagctgagatcactgataaaagcacaaaaagcaaactagttgcggccaaagctatcatgctccgtgatgagaaggtcaggtttgtgagcattgaggacttaactgttagaactcctggaaaacctgacactatggtgtcagaactaaagtacggctcaagcaaacagttgagacgctggaacaaaaacacgtacagtcaggaagtcactgatgtgttgtatgaatgcagcgctttagcaagacagttagtcactttagttggaagcaacgttttggctaaacacggaattaacgaacaagaagagtactacgagggtgtgcgagctgtgactgactttgcccacaagtcagcagaaatcgcaaacacttatgcaagcttcgatggtgattctctcagattggcaagcgcaattaagcatttacagcaattaagggaccgtgaagcaacggcccaacaagacgcagccactggagacaccaccgaggctgtgaattaagtatgggtgtagagggcgctggcaaggcatatggcgccgcaataaggaaccttgctaaactgcataaatacatgaaaatatatattagtgaaaaaattagtcctgtgagaccccaatacgttacttcggggcacacgacaaagagtttaaatgtgatgagagcaaattcggaggaggatgaggactaccatgctacattggcggcctgtgttgaatggccaatgatgcaacataatgttagctggaagaggtggatgaaaatgatggataggatagtcactgtaaactacagagacttccataagaatagtggatgcatggctgtatcttttgagtatttcaaaagcgcctacagtgatgcagtggtgaagaacaaaaaaggagtgtaccagtacaagagcgtgcacatgtgtggagaaccattagggcaggtcatagtgaaagagatgacagatgagcagattagtgaggtgaaaagctggccaatgcaatttgtttttccggataaggtgcatgatgaggcgtttaccaaacagaatgtgtatgtgaaggacgtgctagagaccttgagcaagtctgacccaaaatactacgaaacagtggtggacgagattccgtacctgatagggttggcatcagaccaagtgtgctgcactataatgtcacactatgcgcaccacacaaaaggttgggtggtgccactgagaaagtacagggccttgttgtacaaccaagaattgtcaaaagcggttagcgatttcgcaaaaatatgtggagtagcactgaacccctttcttggcccttttgccgaaatggacgcactgcgaggcagaggcagtctgccggcggacccacagaaagagctcgatgagctatctggcattggagtgccgcagggacatgatgtgcgttttgaggacggcattgtcaggcgagagtgcatgaaattgtttgagaaagcaatgcctactctcgcttccttacctgctgagagtaggtgggagagagcagcaatgccgctcgattcatactggaagaaacgtactcaacattgtgtcaacgggtctcaccacatgcccagacacatgaaagacagcgatcctaccaaaggaatgcgcagtgtgaccagaatggtgtacttggaaaacgaaacaaaaaatcctatgtatgcgaccaaaccgctcattgatgcaacactgtcttggaagaacgaaaacccgaaggttagagctcttaagtctgaggacaccgttgggtacttgaatgaagactacataatgaaagctgtcgaaagtgcgtggacacatgatgaggtactgattgatcccgggatgccgacaaaacaagatgagtgcaagcgcatagcggagatggaagggaaagtgtacgtgatgctagactatagtgcaatggacaagcagcattctttaaggagccaagatgaggtgttggaggcattaatggacttcttgggtgcaccagagtacataagagagtggatgcttaacgcgaacaaaaaccagtttttgacgtatggaagcaggacaatcaagttggtgtatagcctgttgacaggcagaagaatgacaacctttttcaacacggtcttgaactatgtgtacctgaaaattgcgctaagaggtttgagaccaacaagtgcgttgtatgctggcgacgacatttgcctgagatttaatagtgttcgagacgcaagagttgctttgcagcacgcgatatcgtcgaaaagtgtctttaacccgcgtaagcaatcatggggcttgggtgcggaattcttgagaacggcagtcatgggcaatagggcctatggatacgttaacaggacaattgcatcaactgtctgtggaagctgggtcaacgttttgcggcttgctgaaaaccatttgtttggactttttgctagatatgcctggatgcttgacaaccgcctacgtgaacatggttttgcagcaaacttgctagtcaacagtatgtggaaaaggacacagatgagcaaacaaatgtgtaagagaattcttcgccatgaagtctctgtggatgggtctcctgtatgtggcaacatgcctgctgtcactataatgaggcctcgaattgaagtgattgtgaaaaatgaaatgaaggacgtgagaccaggaaaaggtgccgcacaaattgttttcgacttccaacaagctctaggcgagaaccgactgcctacgagagaggcgaaagagctgacgtctattttgacgaaagcatcatacatgaaaagcctgattaaaggctacgatagtaaagaagtcacacacgaggttaagccggtgtgtgcaaaccagacgaattatactgaataccttttagccaaggctaacaaaggaatcctgatgaagcatccaactttgcctgcagttcaaggtttgataagtcttagcgcattgcgaagacttttcgaattcacagccgaactagaaaaagacatgcgactaacagaccgggaatggttgttcgggaatgattcgtatccagtagtcactgtgcttggcgcagactacgacgacggcttgatgctgtcgaaaatctcggatttcaaggaggcaacccgcattgccagaattaaattcgctatgaggtgttttacttaattgcaacacacctctttgggccaccattgttggccagaaaacaactgagcacatggtagagctactactagtgacaggaaacaaaaacaagtcagccacgtaaagtggttgggtggaattgaaagtcagcgactattccacttatgatatttttacgatctgacacacaggtctgaaaaatgacg

SEQ ID NO: 16 - DNA, 4671 bp, Unknown
  Diatom colony associated dsRNA virus 13
tgataatatgccaacagggttgggtattatcagaacctggggtctagctcggtgcggacccacggacgcggttctaattcctatgcaagggtgggggggcgtattgcttagcagcatatgtatatccaagagtgagaaacttcgggcggaaactcgggtatgcacgccatgtgagtaagattgcagcacggacggaggcaaaccgttgtgaaaggcgtaaactcgtgaagcatggtgacaagggtgcgttatatcctgacatcccaatgccatctagttgttagcgacacaaattgtacgggattatgaatagtttcaaagtagagagtgacggtagtgtgacgacattaccgttggaagtgggagtgcgtgtggacgcatcccacggtagcggcagttttgtcagggaagttcactcgaacgtcaacttccagatagagcttgctgctgaggtggaaaacggactgacagttactcaatcgaggggaggccttgaacgtgctgtcatggaatcagttgatgtactatcggaaggggtgcgttcgagtgtagccaggctggctccgacacactacttctacgagatgcgctcggtgatgtactaccttgggtacctctcaagcttgctgatcgcaggcgttgattggcccgatgaactggctgacatcaaaggtgtgagtcctatggcaagcggagtcaatagcagtgactttgtgtacaatccaaagggaggcaacacgcgcgaggtgatgtatgtgctggctctagcagctcgcggggttggtaagaaacgtatgtttgtatacaacgaacagttctcaccagcttcgaagcctaggtcggcggatgcacgtcgtcgttatttgcaccacaccatccgcactgtcagtgctgatgctgccagttgtgggctgtatggcgaccatatgtttgcatttagccggggtttgtcgtgtggattggtgctgcgcagtcactccgatgaaggtggttgggtcaggaaggcgttgaagcaggcaagttatcctacctgtagtgggatgatctctgtcaacccagacgacttcccactcttgcctcgctttaataccgttcagacaggtaagaatatgttccttgagaactgtgtcaatgtgttgattgagacggcggcccttctgtcggactccgatccagccttggaagtgagtgtttcgagtgtgatgtataaccggtacttgaacaaagatggtagtagcaactacgatgttggtgacaggttgcacagcaggccgtccgcgtttgacgatattgctggtgtcttacaccagatggaaaattactgtgtgaagtacttgaacattatcaatgccgacactcctagcgaggggtgccacgggtccttacgtagaggcacgttcgaacactatctcgaggaggatgcggttgataggcatttcgatctttttgagttcttgccgtacctgtacgtggagtccgcggtcgtgctcaagcacgagggctgtggccgagcggttggaccgaaagccgggacggtacgcacgttgccgttattccctagtgcccctcgcacgatggcgagcgactgttcaggtaccacgcgcagtggcaaacaccaggctcatagggtcttttacgattacaaggactgcagcttgcgtgggatgggtgctttctacatgtgcgccccagcttggaacggaggcagagacaaaggtcttggtagtatgaagttctatagtcgggagaggatcgaagattgcgtgaccatgatgcggcgctctgagcagaaggtactgggagagatggcgtggatcagatctagctgccccgtgcctgcgcccggtgaaggacgtaattggggcggcaaagtcgccctggcgtacttcggaggcctagctcgagccgtgagaaccgcttccactgaggatgttcacctctacaccagtgctcctagcatccgcagtgtgaccaggtttggcgcggcacagtgtagtatggaccgaaacatcaacgccaaataccgtcagtatttaaatgatttcgactatgagatggaggaaatgattgaagattttctgttctctagtgatgtgaccccggtggtcaggaatgtcgtaggcattcgtgaaggaaccggaagtaggcctgaccagcctgagcctcacggcgaggtgtcgagcgatgaacccgacactcgtcatgtggcaccttacgctactgtcgaacagtcgcccacctcaatcgaagaagatataacatcgggcggagctgttgacggtggcgatggatcatagactgctagtcgctgaacgtctgttggaagaggccaaacggacgtgtcgaggcgacaaaatagtacatatggccaataccttgtggtgtgtgcccatgcaagtaaggttgacgagccgtcaggttcgagaatacttggatagttacatacgaggcgcggacaagatcactgtcgcggcgcagcacgtgcgaagagtgtctaagtggttggaggattgtgcggatgataggaatctgttcccacttaaagatcacatcggcgcagagactaaagtaaatatgtttctgagtgatgtggtgcaagacgctatagaagttagggggcgacggtttgtccaatcgataatgcccgtgtgtttggctgctggatgcaccaacgatcaagcaaccgggatgttgatatgggcctgtgcgctcgaggagcagggactaccttcggtaggactatgttccttgacttgggaggcgaagaagaaactaagcgaagtagttaagggcttaggggtggctggctcgccgcatctgcatttacttgcagagtgccagacacttgaaggacgtggcgtgaaagaggtagactgggtagatgaaatggacaagcgaacgaattcttccaaccggcccgggatgctggctccttactcgatagaggagctgggtcccgtagtgaggaggattgtcgcggaggaaagacgttacttccacgtaccaacgtgggaaaacgcctggagacgtcgatttgcaactaccaaaggaggctctcacaataccatgggacgtcggaaggggcttccactccctaaaggtcagctgagcaaacgaaactatgctgaatccgtcgacttcattgaagtggatgcgattccaccggcggggtttgtatcagtgtctgagaagctagagcacgggaagacgcgggcaatatactcgcttaattcagagaattacttccggtttgacgcacctgcgagagctctagaggcgggatggcgtaatagacgcgctgtcttgcgaccttcagacggatctgagagcgtgaagatagagaagagggccagcatgttgaggaggtacaagataatgttcgattacgctgatttcaactcagcccatacgttagaggctcagaaactatgtgttagagagatgttcgctggactggaaccaagatggttgcagtggttagaggatagcttcgataatatgtatgttcgaaaccctctgaccggagagttggagttgatggacgggacgttatgctcgggtcatagactcacatccataatcaatacgatattgaatgcagcttatgtgagactcgccgtgggcgaatctttgtacagttcgttgtggatacaacatgtcggagacgatgtagtagcttcgactgatgatcacatagtagcgagcacgtgcatggctaggatgttagattcaggtctgaacttgcagccccagaagcaagcctttggaacggtgtgtgcagaattcctgcgtatatcgttcaacaaagactttgctatcggctacttttcaagatctgtgtcgagcgctgtgtctgggtcgtgggtatcactacgcgatctagattatgatgaatatttgggtagtgtcttgggccaaatatggacctggagacagagaagtcagagtctgacagttacaatgctgtggtgctcgactttagttcggagattgaaattgacgaggcatgaagcacagggggtgtgttcaggggcagtttcagtcaacagctcgccagtctggggttacgacaagcgagttggacggtcgctaacaatcgggttaaggaaagggggccgtcgatgcgtttccagcattgacggtacccgtctgcctcggttggccacgtctgattttgtggcagttagcagggaatatcgagaattgcgcgcactaggtgtacgtcagcgacagttggatgaggtgatgctagaagcatcatatggcaatctgttcgcccggctccccaccgataaggtctcggtccagagattaagcctagtgttcgcctccacaagagtgagattaaaaaaccgcgtagtaatgacagtcaaatatggagcgcacgaacccggttttttagctagtctcttaaaagggcgcctaaacgacacgttctggcgatactacggtatggtgaagcaagtagacgttcgcaagatgatgagcgactacagtacgcgcgttatgtgcttcggttacggtacaccctacagtgaagctagggagttacagaaacactataacaatggggttaggtattatcaggagtacctagcattaatttgacctcgttataagggtggcacactctaagtgctggattttaggaaatgttttttcttatatgca

SEQ ID NO: 17 - DNA, 1576 bp, Unknown
  Diatom colony associated dsRNA virus 14
agcttttattatatcatcttcaactggtcctacattgattattaattctgtgtaggtctcatgcaagaaatgacttactcaggagttcgctaccgaacttctaaccaaggtgattacatcaccaaacatccatttggcctctcccagatcggttctcacaagtttacacccgttcgacgagatccccatacgaccatcattgatcccttcatgatggaggcctttcaagactacggcgacagattcaacttcgccaagcttgatggatggtccagaagcctttacacacgtgaaggacacatggactccattcaccgaattcagtcacacacacgctttcacaaaccgactgatacttcgatgaccaagactgatgactactgtcttcagatcttccgtactctaggaactgtacgttcactagactaccacacccagctaggccaagttccctttgaaccaaactccgcagccggaatcggcatacccggaaagaaaggagactcaggcaatctagccctagccatcaaccaggccgttgcaactttacaacgatcactcagagacggaatctcatccgttatcgaggattcaacgcctgacatggcatacactcgcacacagctcacacagctcagtgccggtatcaaggttcgcaacgtcttcggacaagcgttccaatacatcttactcgaaggtctatccgcttcaccgctcatggatcacttcgtcacaaacgaaactttcttcttcgtcggctcagacccacgcatctcagtccccaccctactcgaggacttcaagaagaaaggttcattgatgatgagcatcgattggagtgcattcgatacctcagtagaaaactgggaaatcgttgacgcattcaatcttcttgagacaattctcgaatttccgaacttggaaactagagcagctttcgaattctcaaggattctgttcatcaatcgcaaaatcgccgcccccgacggaaacgtctacttcaaacagaagagcgtaccctcaggcagctactataccatgttgatcgactcgatcatcaactggcgtcggatactttatctccaccaccgtgccaccggtttctttcctttcgacatccgtacccaaggagacgacagcctcgtcgcgactagagactcagtatcgcccgaagcactaatgcttcagatcccacgaaactcccaatggcaactcaatccatcaaagtgcccaattggaaagtccggatcttccgttcccttccttcaacgaacgttgaaatggggagatcaatctcgcgatctcgatcgcgtagaacgactagccatctatcccgaatacgaggtagaatcaggcgacatctcagccttccgcgctcgcgcgttatgggaagactgtaactacgagagtgttgtactagctcacgctaccagctatctcgaatctaaatatggaattccaacaactgttccacgcagatatactaacatctggcagacccttttcgaatctaaagaaagagaaggattaaggtaaatccataggaaacttataagagtaaactataataacatcc

SEQ ID NO: 18 - DNA, 1490 bp, Unknown
  Diatom colony associated dsRNA virus 14
agcttttctcttacaaaattttccacaccccatatacaagtgtggatattttacacacccacttacgagtataggaacccccccaccctcctcactactcaaccatgagcgaacccactgagtcaaccactcctactagcggaaccccacccgctcctcggatcgcgaccagccgttcatcgacagcccgtaccgctgctacattaatcagccagtacaccgccgtccccaccgagaacaattctgacacaggactcgtctacatcgagatcagtgccgccaaattgtactcgacctacgccaacaccttgaaacccatcgtgtatggaaactttcgcaacatcggagctcgtactctcaccgaccaagctgaccgaaatctattagacaacgtcatccttaccgtcgcaacgaacgccgtcattgcaacttacgccgtatgccacactaaggcatgcaaactgaatgccggagcaatctcgcttttcgggaactacagtcccgtcgattgcacccgcttcccagcgctcacttcactactgatcaactcgatcggtccagttgaagcccccgctctcccttaccgctgtaccttcgtaccgtacatcgtttgggacaacgtccacgacctcatcacccaggccaactacacttcgcatctttacgaactgttcatccaggccatgaaacgaggcaagaccgtcgccatgtccgacgttgacgtgtccaacaaccagtccaaccactggtggactctctttatgtctaacgtccagacaacgacaacaggagctaccacacgcacaggagacatcacagccttctgcccgttcagcttcgccgaccgcgaccacgccgttatcctcgcagctttcgtcatcgaggaaacactttacgacgtccccggtccactcgtcaccgccaccgttggtccattcgccagaatgtatccaccaacttcagtggaagacatccccgacgtgtaccgcacttcactcgcagtgaacccacacgtcccagccatcttcgcgacctttactaaagtctcgaacatgtctcatgcgtccgccgtaacctttggaattcttcagaacgattccaacatctcggacctcgcattcgaaacggtcaccctaggacccgcacccgaatacgactatcctgtcgactactcgatcactaacccatcgaagaaacgcaagacgtcagaaaaggcctccgccaagtccacttccatgaccacacgctccggactagctaccgacaccatcgaaagcactcccgcagcattgtacattgccacagtgtactatttcgaccatcgtctactcgacaaagtaccaatcgctcgccgatctactgtcgtcacccaagcgaaccagcttgaatagactctcacccgttccctccgtccctcacagaaactaactagaatgaaatgttcagaaacctataggaaccaattaaacttagtaacgtaagaattaacc

SEQ ID NO: 19 - DNA, 12172 bp, Unknown
  Diatom colony associated dsRNA virus 15
cgaaaatgtctgtccgagctggagttgttgttaacaacacaactaccaaggcctccacaggggggcctttagacttagaatacaaaaattatcgttcacacagtcggaatacaaaactattgcgactgcatgaacataatttacaattgtatcacgttggaatgttgactagcaacatacccaagctaaaaccaaaacatttcagaaacaaacacaatgaatatattgaccagtcatacttcaacactgaaccaccatacactggcagaaagatgaccattacaggtgtcattgaaaccgcacatggtgtgaatccgcaaaaaacaatggacttcccttatgtggaggacgctgtgttgtgggagcccttgcgaactagagcggggcaatggattttccacgaacacaagcccagagatgaaaagcctacggacatacgtaaatacagggctcaattgttgaaacatgtgaaacgctcactaccgggcggcaaaggtgatctttcctcttattttggcgagaaaatctctaaagtgtacccgttgtacagcggtttgatcaacggtaaactcaattgcagacacggtatttttatcaaatgcaatcactgtggcgctatagccagtctacccaacacactaactccagaatacaccgacagagatgaagaaacgttgattatgcatcaaaagaaacctatttctagacgtgacgttgctgatatcatagaaggcatagagaacgctgagctccttggaaagtacgatttcaaaggagcggacgtgaatgaaggcatgcagagcatgatagagtggatgatagccaaaggaagcataaattgctataattgtggttggcacgtagcggcgacgcaattcataaaaccagggttttacatcacagaacaatactactatggagattacggtgtgaatgcaatgactttagaagaattcaagctgtgtctacatttggacagaccgcccccagcggaactcaaactgtcacgccaatcacaggaaaggtttgacaacgtagaaatcggaaggatactagggaaaatgaaagtgaaccacatcaacatgatgtacaatgtgcacgaaaatgatgaatcacaagctctaaatgatttcagcaccacacaacttagccgacaacagagattattggaatacatgttaacacctcttgaattgcaagaagtggtgttaatttccgaaatcacacgaatgtgcagtggcaacatgaatttcagacccaccagtataaacacggaacattgtttacatgacatcgtgaccactacacgcgcgtcgacgtggtttgacgaagccaacttgccatctagacaagttacgctggacatgatgcacataaatgtgttcaccgctgccgaagagacagtcaggcataacctgactccgggcatgtacataatgcacataaacacgaactctacagaattgtgggacactgacaaaacaaagttattgacgccagtaactggttcggacgtgccagtcctatgggaccatgaactatgtcacactctatcgaataatgccagcattaagttaaacggaaggagctactctcttataactgtaagagccacttctaacctttgtgtaacccacattgacgacaagcccaattcggaacatgtgagggttatgaggggcaaatccaaaataaaagtgttgttgcccaccatccagctcaattccattgctcagactctgggcattgttggcaccaagtgggaatacaaaatgatagacaccgagttggtgtatcgtttgctagtcaatggcataacggggaaaaagtctgctgcgtctctcatgacgtacatagcagggttgactgccaccagatattcggtgggcggaaaattagtggacttaactaacatacaagtgcaagacggcatcccagagttgttgtacactatggctttgttatcaaaccagcgggccactaggatttggtgccaacaacattatatagcaatcaatgttcgtgacaccagccaaacattatatgacattctgaccaagaaattgttaataattttgaaagaaactttgccggacatgtaccagcaattggacgaaatgctaaatacgaaattcaatttgatgttctctagggacaacaacgtgttgaagcacagaatcactgctaactatgatcacattcaaccttttgtgatattaactaataaaaattttgaagttgagtccaggaatccaactttatgttgccatcacgctactggctgctaccatgctggtaaatatgaatgtacttgttgcgctatgaaaacagacaacattgataaactttgtgactgttgtaacaccaaacatactgtgctacacacacacaaatgtaatcacaagtgtgttggtgaagcaagccatgaatgtttggatagacgtgaaaaaggtatttgtaagcacaccaccatttgcgtttgttgcaaaacacgcatttgtgcggtcaggtgcccttgttgttttgatgaattgttttgtgcaccaactgacagcaaactggagaggccacagttaaggaagagcaaattgccacaaccggttgatcttacccagactaaacaagtgataacagtgaaagaaagcgcgccacgtgaatcgaaacaaacaaaacctgcagacgtgtcaagaaccaagccacacactacatttaggactgcccgtgtgactaagaatctcagaatcggcgaagaacgggttcgtgtgaaaaacctgcgcgatttggaaccacaacatttctttttctacaacattgaagggttttgctacaacttttacaattgtgttgaaggagaacgattgttggaagttacgccattgtctaacgtagatatcgttgattcggtgaacgttaaaacgaaatgtttgctacaatgcatttcacgacaaacgaacttgactattgaccagttgacaactaccactgagtataaaaatgagcatactattaaagacgccattgccatcgcaaaacagcatgctttgaacatggtgattcaagatagccagacaactgctacgatgataaggtttggggcgatggaaggtaaatatttattaatcgcacacaacaccgcgatagttgacgacaaccccagagttgtaggtcattggtgcataccatcaacaataacacttagtaagttaccgtacggtatttggaacaacgcagactacagtttgtatgatataagtcgctttatcgatgtcgacgtgttttatattaatgatgatgaatacactaagcataaaatgcgtatcaatgaagttatgtcagccgttgtttccaagggcttggcatttcctggggagtttgaagttacctcaggagatgtgacggtggtttctaacgcaacgacgaatgaacctgtggcaggcatgtattcatacaaactgcccgcggagacagcagaaatagcaaacgctgctttaacatttgactacttgcctggtgacctgttggcagtcacagcatttatagggaaagaaactcccgtctctgagatggtcgtggaaaaactaaaatcccaactgcgacaaatagcatttgttcgggaaggtgtgaggaatgacactattgatgtcaaaactagaatccaagttaaaaacgcaggaaacttactcagactgcccaattctcttaaggtgtacaaatccttagaatacgtgcgtttgaaatctaaaacgggagtgcaccagtgggctgttacgggcaagaacagagcaggagtgtttgtgaagaacccatttggcagtgacctggttgaagtcgcgtcaaccaaattgtcattttcttccatgcacagggaactctacatgctaagcaaggcgttcaacaacgtgcctcacttaaacactatgacgctgaacaatgtggtgaacggaatacctggtagcggtaaatctttctacattaaagaaaacttggccaaacctgacacggtgctgctcagcaagtttgcttcagctacacaagcatttgcagctgtgggatttaagtatgagtcaactctagaagcagcagccattcgcgatatagaagaaacgaagatagtggttgatgaggctggcgcaatggacgtagttgacttgttgtctgtgttaaataagcacaacatgaccgtcagcctatttggtgacacaaaacaaataaccacggtggattttagctccacaccaggtgtgatgttggatgttaacgtgttggactattacaaagacatttcgacacagtggaatgagagtcatcgttatggcgatcctctgctcacagacgtcattaaattggtgtatcctggcgctgctaaacatgtagatgtcacgtggcaaaccacttacgctttgaaacactgtgatgactttgacgaaattgtggaactaattaatgaagggtcgttcgacttggtcatgtgctttcatgatgaagcaaagttgtacttggaatctaatgtaaatgaaggcgtaatagtaggcaaggctcacgcaaatcaaggcattgaaggtgacaatgttgctgttgtgtacttcaaccctgcaggagacgctacgcccactggtatattgagcaaaaagaaatacataaacaattgcattacgcggtgtcgtaagaatctcactgtgtttacaaacatgtcgagcgtgcactcggtgcaggaaatggttacgtactccgtgtccggggctggtcatgccggcaccaacttaattgacagcgacgatctgcgactttatcgacttccaacgacagacgaaattaacgtgataaagaggtacgtgaggaaaatgtatgacggtgcggcggtgttagaaaaagtaggcaacgctgttgatttccgctgcagaataaatggcgtggcaatagacttgactctaactactacgaacaccacaccaaacaatgcaaaaactagagtggtgatggtggggttcaggtcaaagttgagtgcagtgttggaggagttaaatgacgtagccatgtcgtcacaagacatcaatgacgctactgacatgcacatggaagtggacactgctgacgaatcatcagaatcagcaactacgttttatgatgctgcagaaagtgaagaggacatggacatgtatttgtccgacagtattggtacggacgaaacagcggaccgtaacggcactattgtaacgtatagagcggttgcctctcacgtggtgttgtcctataagttaataccgattatgtggtcacgtttattgatgatagccgatgcttgcttgttgaaccaacgcgcattatcgggtttgaaattgatgctgtgtggtgaactggtctcggtgaaaatctttgatgggtgctcgctgttttgcggcatgaagttcacgtttagcgacggtcagcacgtaagcatgagcagcgcgcacaccaaaaatattgaggataccaccacagcattgagcagtcaagtccgagcgttcgttggaccaaaacaaaggattcaacatctgattgccaatttagaagatcccgtgaacacggaattggggctgatgcaaaagacatctcttattcgacgtattgccgaacgactcaaagttgtgttgaacagtaaaacgagaatgttaagcaatgacgacagagtgttcggtaattactacagcgagttaaatcgcgacttctatgaagaatttgagacacgcacaggaacggtgcaaaaacgcataacacatcaaaaagtcaccaaactgttggtgcacgacgagtccatagtcaaactgtacccaacgcaaaaagttatgtatactttaaatgacgtgatgaaacaaatgtctggtgtaaacgctgcggtaggtgcagacgtcaacccagctaatttagcaaaaatggacgcaattttgcaaaagaaaattgtggccgtgcaaacggaaaggaaatttataaatttacccagacagtcttggaacttgtggagctatgtttttaatgatttggtttacgagtcgaacattgtgttgttgaaccagcctatgatggacgacactatgtgtgccatcgcaaatagcttggcgttagtcattatgtataaagtgttagacgtggctgagctagatgtgagtggagtggatgcgcaaacactggtgttacaaaactaccacgagtaccggttgttggagtctgatctgagtggtatagaaatgcaatacgttaataacacagtcgatgacatgttatcgtctataaacgacaatgttacaagagcagtgggcgtagagcgcacgaggatgcagcaacaactggacaagttgcgaactgtcggggcgtttgtgcgccagggcaaattgcacaagactttgttcgtgggagctggcaagcaagtgcagtcagaatggttcaggaaatatgaccatgttttcgctctatgtgtagacgagtgtgatgacgccaccaaataccataatggtgacttgtatgtggtcggtgacaatggttttaaagtgtataacgctaggacagactatgaatacaacactgtagcagtgttcggacctttttcattggttaaattggtggagtcacacaaacacgactacaaaacgaattggacaaaatgcaacaagtacggtctaagaacttttgaagtactaggcacaaactctacagaagtaagtatacccaacgtcatgttctccaagcttttgagccgaaccatggtagaacacactacaattgatgatttgttagcatattgtaggtcggtggccagcactgttgtctacaccaacaaaggttcttacagaaaatacaagataaatctagaccagttgcagttgatgtgcatcgttgtgcaaaacatagctgaccgccacagaaaattcttcacgtcagttgacaaactgtttttcaagaacgacgatgatagcgacgtaaagactatgataaaagatcgggtggtaacgatggcaggcaatttgttgacagattacggcataccgcaactgatttcggagtacttcgattggttggaccactcagaccggttgaaccctgcaatatcagcggtgtttaaaactttgtccgacaagcatgtggtagaaacgacaacacagtacaaaattgtgaagttgggcacgtcacaccatgtgacgacattggaggaagatgagtctgacgacgacgactcgaccagctctgaaaccatacgtccagacaatgctgaaaaccgtgacgaggacacaaccggtggagtggtcaacgtcttgggcaaaactcgtacggcgaatctgacgggacaacaaagcagtgaagaacaaacgtttgtgcccaaggaaaaatcggtcagtttcgctctagtcgacgagggcagcaaggaaacactcacaatgagtaacaaagcatcaaagttattgtcatatagggacgtggtgcgtggagtcgccaaggaagtgcaagacaaccctaagaaacacagggcccgaattgtcaaagatggcgtagtgactgatgacttcgtgaaagagccaagccaggaaaaaccagaaatattcaatcatgaacaagtcagtgcaggcataaagatagtaaaatggtatcaacagattacatttaggcgattgtgcatgccaactggtgtgcacgacgctaaatgtgcaacgtgtcctaaagtgacaagagctcaattggtgtcaataaaccgcgttgcctatgatatgttcaggttatttaacaattacgccaaagagcattccctcacttatacactatgtaggggtacagttttagctgcgctgtattatggtaaggtggtgtacttcaacaataatggctacaaacactgggttgatggcgacatagacattgctgtgtttttgcccatgtcagaaaaaccaaagttgggtccacataagatacacaaagacttggctaaattgttaggatccactccttattacaggggcaacacccaggtgtgtgcgtacttgtggtacgacaaataccctcctttaaatttgaaaaaatgtccgaaagtgcatcctcaccacgagaaacatgacagaatcatgcaccactattgcttggatgttgccatcgtgtacatagacgacaaaggagtgcaagttagcaatgacaaagtgagtgaacagctaggattgccattaggaacatatgcggttagtgatttgctaccgacaaacactgtgactgttgaattttacggtcaccaggtagcaatgcctccaaaatggtgggcaacaatgtcatatacagctgcagtttacaagaaaggcaaattccgtgatctatcatacccttggttccccggcatagagacggcaggtagtgtcgtgtgcaacaattacacagtggacaaatcatggtggaaaagctactacaacatgttgagattggacaacagtaagatgtacgattgggttgtacgttcaaaggaaagcatgttcaccactatagaacgcacgaaaccaacgatagcgtgtgttgtgtccggaagtatgggcgatatcaaaccgatgctcgcattcgcgaatgctattttgtgccactgcactctggtcatttttaaacctgaggatgtacaactaccttttaagtgccacgttgtaaattatacagccacctacaaacatatggtaatgcaagaaaacaaagcaggcagactggaaaacattaacaacactattggtgatatggtgcggaatatcaggggtcaatttgattatgtggtaggtatgcattttgctaaagaaagttatttgttgacggcaagatacaagcaaatcagactgtacccattggttacgaaaatgaaatctgtgatattccacgctgcagaccttctcactaaggtggtgactataaacacggacaacgtggtgaagtacagttgtgtgcgttcagacattacatccgagtataccaaccttggtttcgcctgtgacgcttctgtaacattcttagatgaaaacacgcgccacatattgacgatgcaggcagcacatggcgaaaagctggtgttgatcacgttgggatcaatgcgtgtgaaaaacttcagtaagttggtgcagacgattatggatgcacacgtgcagaaaatcttagtggtgaaaggttacaacgtaggtagcatgcagttggaaagagggggagcacaatttaacataacgtctgagaagttctcagcggacctaactgtagtagaatcatgcaactaccactatttggtgcccattgtttctgatgtgtactgtcatgggggcgctgggacactgcaaacatttgcagctgaagatgtgaaaatacacgtcttacctcaaggatatgaccagcgggacaatgctgactggtatcacaaaattggcaaaacgttacaaaggatggaccttaaacacgaacactctacattcagacgcaacgcttgtgccatttttggttttacgcccaacaatgtgacattggacttcataccgaccaacgtgcccacgtttgtgaaaaggtggacaaaaaatgatgccccagtggtaaacgcacacaattgcacttacgaaactgttagtaatgtgataaccaccgaacactgcgttaaaatttccatggaaaaagtgttaggaaatggtacaaatgcgtacaaggcttttgcgctcacttatgacgactttgtgagcacaagaagcgtgttgtctgtgtctgacgtggtgttgttagttatcacctccaactgtacgtgcactgtggtagacactgacaacagcatttgttatagtgtgcagaatggtggcaaaatgccagatcttgctgttgcggtgaatttgactgccatgcatgcttacgtggtgtctgtcactaaaggtgacccatgcgttgagcatacaaaacagtcgattttagccatgtttccaaccacagaaacctacaacgccacgctactgctctcgaactttagagacgtcttgaagggaggcaggatgcaatccagagtgctgtcagaacgtgacgaaaaaacaataagggcgtccatgcgactcgacaaaatgaagcggtatgctgtgtacttaagacaagccaaccccatgactttatgcaagagcaaaaccaccgtgggcgcttgcattttgtcgggtgtaaatttgatgccttgggcatgttatggcatgttcaccaacaaaggttacacaattggcatcgcagtgtctgtgagcgggttgaaaactagtgcattatatcatggtgtgcaagaaaatctcactgtgcatgcaattataaagttgaacacaataaagaacttagcggtgaccagtaagctgtcactaggcttggtgtccgacgtgacagccgttaaccagtctacgcgtaaacagtgcgaaaaactaaaaataccagtgcaagctgtgtgtgtgttaaatgcgaaattgtgttttgtgcatacaacgtggaataggaaacaccatttagagaaagaaagagagtgtatacaaacagcagtggatgtgaacaatgtaactaaatcacttacacctgtagacaaactgcaactgaaaaaactccgttgtcctagagcatttgtgtatggaggtaacatggcatatggcattgagcctgacacagaagaaaacgcagcggtgacaaacagattgttgtcaactatggttggcttgaaaaagctacctcacatgaacgtgcattatactaatgacgctggcctcatagacgctctgcgcacaattttcacgttatcatcagatgaatttgagaagcacatgtacgcagaagtgttgaaagatttcgagttcgaccgtgtaacaacagtcaacggtttaataggcaaattgcgtctacaaactgtgacctctgtagtcaacgcttttgtcacaagtgcgaatttggttggtgccactgcagacaatttgcagctggagataagcagcggccataaattctcgataaaagtgtgggaagaagcaatcaactcagaggcggtgtttgagtacccgttcgtcatcgtgggagtgaacgctatggtgtacaaggctgtggcatctggctatggaattgacaacacggcaggtattaaagtcatggctgacggggaagacgcgatggattacgagacgaaatatgacagacaaacagaaaacaaatttaacgtgaaacgaaacgacgaatacagaaagcgaacagatggtttcgttgcaaacgtcactgccatgtctgcaatgtctcacgagcatttgtcaaccgaaaatgtggactgtccagagttggtttcaacctcaaggattgttcgggttattgagtcaaaagctgggacgtttggagtggaagattgtgttataccagatataccagatgtgaaaactatggactactgggataattttaccgacttacacgacaacgttgttgtgttaccaacacgagcggatttttcaataaaatctaggctggagcccgatggggtggtcacaacggcaaagttgagaatggaacaatatccgactgtggcacgaccttcgatgaccacaacgatggcttccacgctaaacagcatatcaactaggcaaggcagctttgaaacatacaaaacaaaaccaactactacggcgctagaatataagttactgcgcgacaactatttgcgcaaagattttgaaatgttgtcagcacgatacaaatctaaacaaataaacctggacgctgaagcgacaatgcattgggttgatgaacacaacttccctgaaatggttcgacaatcattgaaagatttgtttgacttgggtttcgagatgaaccccattaattccattaaagcacatggcaaagtggaacaaaccactagattggccaaagcacaacgttggttcacggaagtgcacacgcggtcaattatggcaagcgcttattgcatatcggctctattttctccagtgtttttgcaaattaagaaacggtttaaagactcacttaaacagaacatcgtgtatacagacggcatgtcaccaaatcagttaacagctcacgcgtccacgtttgaatgtccaacttggattgtggaagatgatttgtccaaacaagacgctgctaccacacacgacatcattgatgttgaattcttgttgtacgctgacttgggttt

SEQ ID NO: 20 - DNA, 6635 bp, Unknown
  Diatom colony associated dsRNA virus 16
tgattcaagcacaacatcgtagacacgatcttgtggttgaatcattttaataaaacttcgcgtaccaaaaacgcgtgtgcatacgcactaattctggctgtcgaacttcggatcggctgaaatttgtccgcacccctctgttggccgggggggtagacgtaaaaacttccagaggtgaccctacggggatcgtggctcttgcgttgtaagattcgcagtgtgttacaagcattcaacgactacacgccacgggagagaaggaatagtctggcctcatcgcgcacaaagtacgaggaagaattgggtatttccttcatcgagcagataatgtacttagcaaacattcttgttgattccggcattaaggtgctcacgcgcctcttctgcccgggactttacgacgaggatatctcgaagcaaatcaccccttcctcttctcttcccctcaacatcgttgatgctgatgcggtgtattggccgaccaatactcccaatggcgacatttcgtcttggcgtgcgcatggagccatctcggtggttgaggctgctggtgatgcccttgtcttggacttggggaccagcgctccttatggagcttttcttgaacgtgagtatcttggtggagtcactcgcgctgaagtgcaacccgggtgcgtgtttggtaatctcaagggccgttccttctttgggaatgtttccgataacatttacgcgcccagtatcggcacttgcacagccgcggagtacaccgcttttgtcacagatggtaagcatgcgcagggtgttgctgctcgcgtggttgcctttgcaatcgaacacgctctggctgagtttacttctcgcctgcgtgttcgcaatgcggcagcatgctactggtcgctcgctaagtatcggcaggataatatcaatttttctctgcagaacgctggcgttgccggacagtggtctagccctatggtcgttggcgctgagaatgatccgacggctgtactgtgggttgggccggccgtgcacgtgcgcggaatgtcgctgctctctcgcatcatggatgcgggcggtccactttacggtcagcgcagctaccttctggagcagttcgatccaggacgcttgctcatggtgggcaccggtattttgccgcgtgagctgcccaacgtgcaagcgaatgatctctggattgctattcgtgaggcttttatgattttagagaaatttaatcatgtaacggaatcctttattaacagtactttccatgcccttattcacaatttgcccgtgatggatttggccaccacgcgtgaatgtgagcacccgttgtattgttctacaacacgtgagtatggagatgcagtcatacccgccgctgatgctgctcgtctacaagatgctgtggatgcgcatttcggcgctgatttggatgtgcgcctaggactggcgaacacgcagcccaatttcacacgaaacatcttcgctgaacttgggcgcgatatcgtattgtcgcctccggataacgaggatggctttgcaccgccgatcaatgtgcaggtgactgctcacgcagcatgcattttaggtcaaaatagtgcggcccaccctcgccccattcacaacgaagtcgctcgccaattctcgttgacagcgccaaatgcgcccatggtgcatccaaattcagcacctcgtgttcgcgatttcgaaggagcgtgggctgcgctcagcagtcgcgcactttttcgtgtctttgtatactccgctggcccggatgcaaatgggaatatcccgatgacacctggttgtgtgactgtagcgaatgcgaacgctctgaacttggcggcattcactccagcaggtggagatggggagtggcaagaatacactcaaatgcctgacgcaaatggtgttgcgcttttgagtaacacgatgcgtgcatatgttttgcgctcatggttgcccacgcgcccgtcgcaatatcgaaattacgtcgcgccagtgggtacgctcaaacgttttgatgcaccaccactgctagtgctccgaccctcagctattggtcgagcgcctgagtgggaatccaatgcgcccaaatgtggcacttatctcgcagaagttccaacggataacacgcctctcgaatttgcgaccttcgacggtttacgtggctctggctggacggcggatcagaacgtcgctgccttggtgcatgctaccgcgtatctctgggatgctgcgcacctcgcttctacgcagaatgacgcgtatgggcggtgggtgcggcagcatagaggggccgcgcgcctgacgcgcatgccggatgagtttttgactttcctgggcggtgcacgggtgcggaagtttattgaacccgcgggcggtttgtggtctctgtgctatttgcaaaacgtgaatagctacgataatattagtgtcgccgatccattgctgcaaatgttgcgctccaaagcaacgttcgcgtcgatgttagtaaagttgcgcgcgaccatcgatatggctgatagcatgttgcacgtcagcaatagtcgcatggctgagtgcaatgatcctatgtgttacgaggatgagctcttcgaccgcatagcgcgtggtcatgttgataagccactgatgtggaccgccggtgagtacctcaaggcgcaaagtgtggtggtgggtaatatattcgccaacccgcatggtgtgtatctcaacgagttcgatctcgttggtgtaggtacgcaacggctgcgtgagccgcgcgtgcgggctacctttccacggctattggttcagcgctgcaattgggtgcgtatacaagtgatgcgtacgcgaacagcagcgtcatatctcggggtccagccaccaaccttcatgttggaggagcggggcagggcaatgctgcaatcggcgcgtcggctcactgaatggacagacttcagtgaggaattcaagcctggcgtcatggttgatgtgcaagatgagatctggctggcagtgctaaccacgttgcttggtgataagtacgatcctgtcaccttaagcatcagtgcggtcgggcaggtgtgtgaggtgttggtctcacaactgcgcgtccgtgaatgctcattcttgcaccccctggcttcccgactcattctgccccacgagactcggttgcgacagtttttgttggaggagggcaatatcgctgatcggtactgtcccattctagcacaacccgcggccgagcgcggcacaggggcccaaaccgtgcagtaccctaatgcagcctacaatgcgcgaggggtactcacgctcggtgcaccggtcgtgcgagcacgtgtgggcgcccactcttcactcgacgtactcgattccgcgttcgcgactgagggcctccgctttcgtcggtacaatgatagacgtgttgatggcgattacttaccttcaacgcacggtgccgcgaagtcgtggttggtgaagatgaaggagcgcacgcctacgccgcgcccagcgatttcgcctgccgcggttggtattcttgctctcgtgaagaacgagacactccagccgcatggtgccgagggtggtacaataacgacgaccgccacaaccggtgctagtcccagtgccgatccccggactgcagataatccaggcggtggtacaggcacgacattaccgcagcgtgaagagggcagtgctttggatttgcaatcgctggcgcgtactctccaaagcgcgacgccggcggacctggagatcatacgtcgcctactcggcacagatccgcaggatgacatctctgctataacagggtccacgagcggcacgcaatcgcgtggagatcctggcagcgggcgtaactccagcgcagaatagggaggtgcgggtgcgctagtcaagttttggtcgaacttggcgacgttgcgaaaccctgaatccgttgttgagcggattctaaaaatgaacaaggcctggggagacggggatgatgccgttcgggacgatgtgaggtcgtcactcttacaactgttaggccacgcgcccgaccccgttcagcaaagcgctgaggttgagggaaccattgagacggtaccaacaccgaagacgcttgctgggggtgcgtggctcagttgtgagaaacacggggaaccagtttgcctcccatgtcgtgatggggtgctactgctgagagatggcgagaggcgcggcttgttgaagcgcctgttgatcggaagaatatccgcgaaggaggttcgcacgttgcgtgatcaaatggtgttccaatcacgcgtgttggaggagcggacgcgattgacgcccaagatcgcattaaggtggctgcgtggtcgccgcgacctcatccctctactttcgctgttgtgtggcgcgatgcggctgggcgcagggaccttttgcaccacagtggcggtcgtgtgccactggggtatctgcaagatgaccactctgttagcagaacgaggggtgtttgggtgttgtcataagtgtgcgaacgcagcgatcaagaagtttcgtgaagtggcgcgttttggcaccactgatgacccggatgccgatccggatctatttgattggcagtacgtcaacctaatgcttggccgctatgaccatgagacttttgcggatgatgatgatctcaccgcgcgcatcgactacgaggcgacactccccgtcaataatgccatgtccatgttcagggaggagttcgatgaggaatatgaacgcctacttgcgattgagggtgagcgatttgggcacatctgtcaagctgcgcggaaaacgagtggtcagccgttcctccatttgacggagaatgtattgaaggcagtgccgacgggcagtgtggctaatgacgggatgagcgccacagcgctggctgaggtggataggagcttgctgaataagaaattggcgatcgcttacctcacaactggtgaggaggcagcatataagttggctcgacagcattccatgtcgatagcgatttggaaattggagttggcgaagttgcgcaaccttgttcctgggtcgctctcgttgtacatggcttcggctcgtgtaagtatgtacggcgagagcgctttcctagcggggctggaaggatgcccactgatgtggggtgagagccacaaggaggttgatgcgctgaggttcagtgagtggcaggatgtcgggtatgtggcgaatcgtgattacaagaattacaacatttgccacaagcattcacgaatgcaaatgttctaccgtagcgcagcgaggcacgcacggcgtatgcgcgaggaggagatggcggatgaattcgaattcttggcgaagagtctggataatgtgggcgtaatgatgcctgatggcacataccacaaatgggaattcgggttgatgaccgggtgggcacatacaatgctttttcactgcgtgcacaacagttgtgccgcgcgtgcagtggaaaaagttattcgtaagcacttcgggtggcgccggtatattgggcggcatcagggtgatgatagtgcggaggtgtggaacgcgccgcttgccggccctgtggcgcaagcgattcttgacgctgcaggccaagtggggcagccaaccaagcaacactttgcgcgtgacaagggctcgtggtctgaattcctgcgtgtgtggtacaaggcaggggtggcgcgcggtcccacgttgcggtcgatcaccagtttcgtgtcgggtgatagccagcatgctccgcatgagggcggcgtggcgcaggtcaaagcgattgtgtccgcagcaaatactgtctggcgcagggccggtggtactttggggtggcggcagcaggatctggctgcactgatcgcgtattgggctgcaagtaatgagcagtatagggagaaagaaactgtcgattggcgatcacatctagcggagggctccgggctgatgtgtgcagcgtaccctgacatggtatggcgcgtgagtgggcggaaagtggatcggcggcggcgttacccacttgaggcgggaccgacacttttgaagcgtgcaaggcgtaatctccagcgcaccgcgcgagccgtaggggctgagaagtacgccgcggaatatgcggaggatctattggagaacagtgtggagcaaagtacagtgatcgtggcaggaactgtgcgggagcccgccccacttgttgagccctgcgttgagactaagttcttggcgcgaaaggtagtggaggcctgcctgtcgggacgcccaggatggcgcaacgaagatcaattcgccgtgcaatttgttgttggctacgcgttctcaggctcggaacgcgttgcacgcgcgtacctcaaggacgggttacgtccttatttcagtattaccgaatcactcttagaagtggcggaacgtggtatctcaattttggcaggaaagacctgtgaagatgccaaacagtccgcctcttactatgtgtgtgcagagaagtactggaaccatgttgagcagataatgcgcaacgaacccgcctacatgcgacttgacagtcgcagtgttggcatggcgatagctcgcgaggctattgctctcggtgatagaatctaggaattgctccgaagactatgccgggaacgcatcgcagacccgattcgggtcccgatgatgtcttagatagc

SEQ ID NO: 21 - DNA, 5907 bp, Unknown
  Diatom colony associated dsRNA virus 17 genome type A
aacaacaaaaggagaaaaagaattttgttgtgaaaaaccaaaaactaacgcacagccaatcaattaagacgtctgttgacaagtacagcagcgcaaaatgtttaaagtattcaaagaagtatatgaaacggtgactaagccgaacgcgtctcgcaagctacgcctgtggaccaaccccaaacccttcaagctcgatgaactcgacgaattgggaatcgatgacaacaacatcataaaccagcaacttacctccccattatcggcacaggaagccgtagctagactagaggggaattctgttgatatgcgctatctgctcatagcaaacagaaagaacaaaatcaaacaagagacggttgtaggcaggaaatggacactgggtgcctctagcactaacgtaatgacgcggacaggagatgactggggcactgttacagtaaacgtgcaccccacctttgccggcatacttaccaacaagaaagacaaggcttttcttgagagcatgagtaacataactagagcatttgcagcgacaagtggcactacggtggacggtgccgctaaacgggcagcatatctggtcgagaaaggaaatgtaaatatggtgcgcatggtctatcgtcttgccaagatgtatgcagtagccacactgagcgaaaagaacaacgtgaagtgcaccattgacagctatgaagatgactgtgatctcagggctctcacctcattgaacgtattcgaagacagcctgaaagaagccttaaccggtaggaactatatatactatgagcaaacccccgccacacctggaagcgaaaacgctctatctgtctatgcagccgcacttgacacgcccacttatgggcatcgagttcgtagagctgctggcaattccctactatctttttggcctgacatcggtaagcctgtgctgctttataaagccaacactcccgaagagcaactgcgatcattcagtttctctagcttagatatccacaccgcagccaacgagctgctggtgccttttggcctgatggaattgttttctgaggccgtcagggagatgtttacgctgagtgcggcccctgaagatgctgagaagatgctgggtctcgatgacatcgaagttgccttgcccaaaatggataccagtgttctcgcagccggaataatgatagaaaccattaggcaggccgaactaggcatagactaccacaacccgatcgagctgcaggaaatagcactacaatcaaccatagcacgggccgagtttgaggtctgccaccgtacagcactcataggtgcaggcgggctcgttgacatgatcggccagaacatggacgcgcaactccgcagggctcaatatgtagccgcaaggccgtcacgtacagtcaatgctctcacgcggcaagctgcgagcataaaaaaagcggcgttcgcgcactcaggatttgggcggcttctttccactacatgcttcataccttacgcatcgatgcccgaagtgcaccaatgcctcaaggacatagtaacacatgcacacgccatacagtgggaagagacagcgctatgggctacatcacttccatatgggaatacattaacagcccttgtgacccccatgacatttgacgccacgaaggtgaaagcaaatgaggtatacaaacccgtactggatgatgttacaacctccgatgcacatgctctgcagtcgctgtataacagcagggctgccgttggtcgagaatttgatgtggcgtacttgaccactaataccgcccgcactctatggacacacaacatagagcgttatgttcctgagaaaaactacagaggcgctatagctgatatgcaattcatgccctattccaacgaagaacttcatgtttccatgcccgtattagccttccggacccctgtcgacgcgttagcgtactccaacgacgctgcgctgcgtcgcgaatatacctggtacatcgatatgctagacgaacaatatatatccatggctacggcgctaaacacaacactgcaaccgatcaacaaacatccgatacctgcaccagccagcaaggctactgtgctgtctgttgacctatcagctgctggctcggcgcagagcagctctggtgccgtcacagacctcgactcaaaaacagaatacacccaacaggtacttgacagcactcatcaagagcctctagaagtggacaagagttcgagaatgaaaatagcagcagcgcttgacgacatcgctgagcagtactacaaggctaacgggcttgaaccgagcaagtggctcaagaacttcatggtcggtgtggcacaggcttcaactgggcctgaagaagccaacagagcatcgtcgctttcaaacgtccattctatattgactgcatgggatcctgtggaagtacttaaggaactgcctgtaacacagaggtctgcattcatggagaacatgtctcacatatgcagggccgcggtcgtttacgcaagcccaatacaggcgtcagccgaagacttcagtaatacagctgaacgcttccaccgcatggctactagcctacaaagcaacccgggcctgacagtagaagaagccaacaagtggtggaccaactccttccgtacacaacgcaatgaactgactagggaattacgtgctgtacaagaagagcttgatgccacaaaaaagaactactacaggaacccacgaaagcgcaacatgctcaaggacagacaagtggagctctctgaacagcttcaattactaaagaacaggcagctgtcccaaaacgcaggtgatgaagatgtgcagaatgctttcaagacaggaaagcagtacacatctctgctcaagctgtctcaacaggatgttgagaagcgtaaggcgctacaagccgaagcagaacgccaggctgaagaattgttagcccgcttggacatgtcaactgttgcttccatgaaggctgcagggctggaaagagaagaattagttgctatgggctatccagtaacacaggagatatgggacacacttgatctagaacaagtcgcggctgaagaaacacgactggcacctatacaagatgatgttccagcgcctatgaaagacctagacgaattggctgactattacaaggagaaatacagatcggaattcgagtgggatgctgaaccggaagtggtgcttgaacatgctttaactacactgggagagaccattccagaacactacgaaggctcgatacctgcagcaatacaaatactcatgttgggggagccggcagcagaagaaacgaaagaagagtcggattttcaggaagaaccacaaactggtttgagtggcccagccgatcaccctgcagaatctgtggagcaacagggagtgcagcctccaaagaccctgcaattttcggacgagcaatagtgcaatggtggggcaccctaaagcagtgctgccgtgcatcatttagggtgcatgacatgccacagtgcgcgcttgtggaagattacactaccctgcggcacgaatgcactataacatcttatgtcgcaatgacacccccattgccgcagcactggcccacactagaggactgcaagaataactacgtggcatttccagctgggctcggaggaccaatcaaatttacgataaccaccatatcggagctgttccccaaccccattcagcctacaacggcgctcatattgcattttaatgtgggcgccgtagaagcacaagtggctgccatgctgtactgggtgcacaccgcgcctaggaaggccgtggatgtgttaacgtctcacggatggttccacaagcccctaaaacaatgggccgacgtattcaaagacagcctagacaccatgagacgtcaagccacagtaccagggtcgctgaacgaccatgagacgttctcagcacttcggaagataatgtcattgacctaccgtggtactgaagagcctgactgggatgctgaaatgtcaaggatgagagagaatatgccgattagatcatttaataagctaccgagagcactccacctgaattacaatagggagctttggaacgcgataaaagaagtgacggctacgactgtgcacaacgtggtgcgcaacaccaggcagcgctccatggacgagtggtgggccactaggcgtgcatgggcaccatcaggatcatcgaccaatagaagacttttagatgactacaagaaacgtgaaccacgtataaaaagtgctgatcgtgcttcgaaaaaaaccgttgtagaagcactacctgatgactacatggaaaccagcttagcacggcctccgataagcctcgctaggaggagcaagaaatccgaagcagggtggaaagcacgggcactatatgcctctgacgatgtgcccttcttcatagcatcctatgcatccctagacatggaaaagaatatgaaccatgatggtatgaaccctcggcagacgcccgatgacgttgctgcgtgggtgctagccgacgcacggactacaatgagcgatgtgtggctctcccttgactatagcgactataacaaagaacacagaaacactgaacttgcacttctcaatctggggttcgtgcttgcttgggctgtcgcgcctgttgatccgtctgtgagggtcgacaagatgcggtgcgctctatggacagcaaaagctcatctgtgtgcattcgtgtcagacggtgaacacacacaccgcatattttcaggactattctctgggcaccgtgacactgcgagggacaacacacttttacatgctgtatactcgaagttggcacgtaaagtagtctcacgtataacaggagcacgttgcgagccaaggttcattgctatgtgcggagacgacgaagacgcctgcttcaatagtgacataatggcaatgatgtacttacatgtgcactcgtgggctaactggacgctcaccgacaggaaacaaatgctcggaaacgcctaccatgaatacttgcaacgcagcgcgttcaatcgccagttaccaacaaaacccttagcaacaatacttgagaccatggctacaggcaattggtacaaacgctcagccacatggtatgacagtgtaatctcagccgtatccgacaattgtttcgagatggtgcgtcggggtgtgaggctagaaaacgcccaggcgttggcacgtaaactaatctcagcgatgatgaaaatcaaacgcagtgatggcaccattaagaagttagagtggtggacatacagagacccgtctgctagtcaccctttatggatgtcccaagaacccactgctaccccacccataactagtgctaagccaaggccgtcatactcagcaccgacccacgccactgatgcttatataaagcatgcctacagcatattaacacacctagaacctaagaaattggtcctatacaaaaatgagatgctatgcgagtcatacggttcaatacacacatcatggagaatggacttgaacagacaagcagcagagcaactatggccagagcgccactccgaacccttgttacttgaggcaccgcagccacctgatgcacgcgaaaaacaggactgggtgattcaaggaatgctctgccgcgcgaagaccaatacgccaacaagtgaacgcgaggcaattgccagaatggggctcgacccatcactcgtaaaatatttgggcggagtctcaaaagcgtggcgtctgaccgatccacacaagcttgcacggtatcaggaacctgttgaaccttgtgcacttaatccaatactctattacattgattcagctcttgtttcttggatgaccgccaccccacacataccccgtgactaccgagcgtaggacaccggggaaaattaaggcccccacgcctttcccccc

SEQ ID NO: 22 - DNA, 5909 bp, Unknown
  Diatom colony associated dsRNA virus 17 genome type B
aacaacaaaaggagaaaacgaattttgttgtgaaaaaaccaaaacaactactaatataatcaatcaaataagacgtctgttgacaagtacagcagcgcacaatgttcaaggtatttaaagagatatatgaaacagtaaccaagccaaacgcttctcgcaagctccggttgtggtccaaccccaagcccttcaagctagatgaactagacgaattgggccttgatgacagcaatatcatcaaccaccagctcacctgtccactttctgcccaggaagccgtagccagactggaaggcaattccgtagacatgcgctatttgctcattgcgaatagaaaaaacaagattaagcgcgagatggtggtcggcagaaagtggacactgggtgcttccagcaccaatgtcatgacacgggtaggcagtgactggggcacagtcacagtcaacgttcacccaacttttgctggaatactgacaaacaaaaaagataaggccttcttggaaagcatgagcaacataactagggcattctctgccactagtggaaccactgtagatggtgctgctaaacgcgcagcatacttagtagaaaagggcaatgttaacatggtccgcttggtatacaggctagctaagatgtatgctgtagctactctgagtgagaagagtaatgtaaagtgcactattgatgggtacgatgatgactgcgatttgagagccctatcttcattgaacgtgttcgaagatagtctgaaagaggcactaaccggacgcaattacatctattacgaacagaccccggccacaccagggagtgagaatgcactgtcagtctatgctgcagcgctagactctccaacatacggacatcgcgttcgtcgatgtgctggcaattcactgctctcgttctggcccgacattggcaagcccgtactactgtacaaggccaacgtaccagaagagcaattgcgctcattctcattcactagtcttgacatacacactgcagctaatgagctattgacaccttttggcttaatggaaatgttttcagaagccgtacgcgagatgtacacgctcagtgccgcaccagaagatgccgaaaaattgctaggcctagatgacattgaggtagccctcccaaaaatggatacgagcgtgttagcggcggggataatgattgaaaccatcagacaagctgaactgggcattgactaccataatcccattgagttgcaagaggtcgcactgcagtcaaccatagcgcgtgcagaattcgaagtgtgccatcgcacagccctcattggagctggcggccttgttgatatgatcggcgaggagatggatgcgcaactcaggcgagcccaatatgtagctgcacgaccatcacgcaccgtcaacgctcttacacgccaagctgccagtataaagaaagccgcctttgctcatggtgggtttgggcgcctactgtcaactacgtgtctcataccgtatgcgtccatgcctgaagtccatgaatgtctgaaggacatagtgacgcacgcgcatgctgtacagtgggaggaaacggccctgtgggctacctcactgccctacgggaacaccttgactggattagtcaaccctatgacatttgatgccaccaaagtgaaagctaacgaagtatacaagcccgtactggatgatgtgacaacgtccgatgcccatgctcttcaatcgctgtacaatagcaaggcagcagtgggtcgcgagtttgatgtcgcctatctgacgacagacaccgcgcgcactttgtggactcataacatagagcgctattcgccccaaaagaactaccgaggtgcaatcgccgacatgcagttcatgccctactcaaacaaagaactacacgtttcgatgccggttttggccttccgaacgcctgtagacgctctagcatatgctaatgacgcaatgctgcgccgtgagtacacctggtacattgacatgcttgacgaacaatacatatccatggccacagcgctgaatactgtactgcagcctacgcacaaacatccaatccctatacctggagatagagcaacggttatgtccgtagacttgtccgcagctggctcaggtggcagtggttccaccaccctaaccgatctggactcaaaaaccgaatacacacaacaggtacgtgacagcacgcaccaagacccccttgaggtcgacaaaagttcaaggatgaaaatcgccgctgctctagacgacgtagcagaacagtattacaaagccaatgggctcgagcctagcaaatggctgaagaacttcatggttggggtggctcaggcatcaacgggacctgaggaagccaacagggcatcgtcactgtcaaatgttcactcaatattgacagcctgggaccccgttgaggtgttgaaggagctgccagtcactcagcgggcagcattcatggagaatatgtcacacatatgcagagccgcggtagtgtatgccagcccaatacaagcatcagccgaagacttcagtaatacggcagagcgatttcaccgcatgtccacaagcctccgaaataatccaggactaactgtcgaggaagccaacagctggtggaccaattcattccgcacacagcgcaatgaactgaccagagagctccgtgccgttcaagaagaattggatgctacaaaaaagaactactataggaatcctaggaagcgcaacatgctaaaggacaaacgggctgaactgtctgaacagttgcagctgctaaagaataggcaactgtcacagaatgccggagatgaagacgtgcaaaatgcatttaaaacaggaaggcagtacacgtcattgctcaagctgtcacagcaggacgtggagaaacgcaaagcattacaggccgaggcagagcggcaagcggaggagttgctggcccgcctagacatgtccacggtggcgtctatgaaggctgccggtcttgaacgagaggaattagtagctatgggataccctgtcacgcaagagatatgggacactcttgatctagaagaagtagcagcagaagaaactcgactagcaccgatacaagacgatgtcctcacaccaatgagagacatagaggaactggctgactactacaaagagaaatatcggtcagagttcgcatgggacgctgaaccgcaagaagtgcttgagcatgctctaaccacgctaggtgataccatccctgaacactatgaaggccccataccagcatcaatacaaatactcatgcttggagagcccgcagtggaagaaaccaaagaagagacggattttcacgaagagccaccaattggttcgagtggcccaaccgatctccctgccgaatctgcggagcaacagggagtgccaccaccaaagaccctacagttctcggacgaataatcatccagtggtgggggacgttacagcaatgttgccgtgcgtcattccgagtacacgacatgcctcaatgtgcgctggtggaggactataaactattgcgccatgaatgcatcataacctcgtataccgcgatgacgcccctactgccacaatcctggcccacgcttgatgaatgtaaaaccaattacgctgcgtttcctactggactgggcggaccaataaaattcacaattactacaatggcagaactgttcccaaatccgatacagccaacaacggcattagtactacatttcaacaaaggtgctgtggaagctcaggtggctgctatgttgtattgggtgcatacggctcctttcaaagcagtagacgtcttgacgactcacggatggtttcacaaaccgctaaaacagtgggcagaagtattcaaggacagcctggatacaatgaggcgccaggccactgttccaggcgccttaggtgaccatgagactttctccgcgctgcgcaaaataatgtcactgacctaccgtggaactgaagagcccgactgggatgccgagatgtctcgtatgagagaaaacatgcctattagatcttttagcagactccccaaggaactacacttgaactacaacagggaattatggtcggcaatacgcgaaatcacggctacgactgtacataatgttgtacgtaatacaagacagcgatcaatggacgagtggtgggctacacggcgtgcctgggccccgtccggttcatcgaccaacaggcggctactcgatgagtacaaaaagcgtgagccacgagttaaaagtgctgacagggcttcaaagaagacagttgtagaggctctcccagacgactatatggaaagcagcctggctcaagcgccaatcagcctcgctcggaggagcaaaaagtccgaagctggatggaaggctcgtgcgttatacgcgtctgatgatgtccccttcttcattgcttcatatgcatcactggacatggagaaaaacatgaaccacgatggaatgaacccaagacagacaccagatgacgtggcggcatgggtgcttgctgatgctcggacactcgtgcacgatgtatggctgtcactagattacagtgactataataaagaacataggaacactgagctagcactgctcaatctagggtttgtattagcatgggccacagctccagttgaccctactgtgcgagttgacaagatgagatgtgctctgtggacagctcgtgctcacctgtgtgctttcgtatcagacggcgagcagacatatcgcatattctcaggactattctcaggacatcgcgacactgccagagacaacacgctactgcatgctgtgtattcgaagctggcacgcaaagtggtcacccgtataaccggagcaccgtgtgcgcctaagttcatagccatgtgtggtgacgacgaagatgcatgtttttcaagtgatatcatggccatgatgtacctacatgtgcactcctgggcgaaatggactctcaccgataggaagcaaatgctcgggaatgcttatcacgaatatttgcagagaagcgcctttaaccgccaactaccaactaaaccgctagcaaccatactcgaaacgatggccaccggtaactggtataaacgatcagccacatggtatgatagcgtgatatcggccgtgtcagataactgctttgaaatggtcagacgtggtgtacgcatagagaatgcacaggcactagcacgcaagctcatctcagccatgatgaagatcaagagagaagatggaagcgtgaaaaaactggagtggtggacataccgggacccaacagcgagccatcctctatggatgacactcgagcccacagcagcaccaccagtcactagtgccaagccaaggccatctcacgcagcacctacacatgcaacagacgcatatataagacatgcctacagcatactcactcacctcgaacccaaaaaactagtattgtataagaatgaaatgctatgcgaatcatatgggtccatacacacctcctggaggatggacttgaatcgtttagcggctgagcagttgtggccagagcgacactctgagcccatgttaactgagcagccacagctccccgatgcacgtgataaacagcactgggtgttgcacggcatgttgtgtcgagctaaaaccaataccccaactagtgagcgtgaagccattgcaaggctcggactcgacccctcattagtaaaatacctaggtggcatttctaaagcctggcgcctgactgacccacataaactggcacgataccaagaaccggtcgagccgtgtgcacttaatccggctctatattacatcgactcggctctggtgtcttggctcactgccaccccacatataccccgcgattacaggaagtaatcagtgggaaaaacaaggcccccacgcctttcccccc

SEQ ID NO: 23 - DNA, 11413 bp, Unknown
  Diatom colony associated ssRNA virus 1
agaaatcttttgatatacatgcgcgtattttacgataacgagcatccaatcaaagcaagcatgaacttcttgcaacgcacggcccaaggcctcgttaaggcgatcatgccaaaaactaaaactatcaaacagcgacgcagattcagtgctcctagcattttatcttcgtctgtcatcaagtcctccgacatggaggcacaaataaagttcaagaggtctaaagcttacaatagcacacagtatcgtactcacctgttgaagaccaaattgcagaacaccgctcctgtgaaatctaatttcaacgttacaggaaagaagattatctctgtgggaacgagtgaactatcgaagctactgtccgtcaggaatgaggtggaaacagttgacagatttattgaacctggaaccaaatgtgacgtgctgctgcttaacagcaacatcatttcgcaaacctcagcggcatcagtgaagacatacgccatatctctaggagcatctatggtgattaccaacttgcctctgacacttccagcaattggacgttacaacgagctgacggtgtttgccacgagcaataactaccagcatgtgcacgctttgcagagtgaagtttttaggagccacacagtcatctctacggatgtcagagcggacctgagtaacctttggagtaaagttgttaatttcttcactggcagcatcatgttcccgacacttgatgaaggcctcggatctaatttgcgtaggtacaaagcgaataacaagatatccaagtgccacgccttctcccagggggacatcctggtttcctgtgatcacgctcataaagggagaaagtatgttctgaatggcaaaatcatcggcgaagtgaacagatacgagtcacaggacatggtgtcgtctcctgcagaaattccacgcaatttctttgcctacgcgtcagttggagaaacagtcttcgtgacagatggcagatcgaaccttgagggtcgagtaatatctcaatgccctcctcaattcgctttcccgggctctccagttcctggttggtcaggattgcccattcaggttcatggaaactcgcagcagattgcaggcgtttattcagctcacaaggttaattcgacaggtcacatctcgatgatggccaacgattactggactgatattgttagagacacgcttctacaacatgactcgattagtgttaacgtgccttgcggtacagggaaaagctctttcttggtgcaaagtctgaaaccgcacttccgttctatcctggtcatcgaaccgcgaatctctctagtagacgcagtttcgatgagattggggaatcggtgggaacgttgtgcggagaaagacgagttcaaggctcagaattacctggtgataacccatggtaaattcattagcacgctactgtctgatgcgcacgcgttctccaagtatgagctggtcatccttgatgaaagtcacgatcctagctggctaacgcgatcttgcttgcactggatggctaacacgtccacaaacctgttcagaatggcgatgacagcctctcccagcaacgatttgtatactcaattgagtctagatcagagcttgttcgacagaacttacgtcaaccactcggctgagattaccttagacactgtcaagaagatgtgtgatgaaaggaatgatgaaaagatcctcgttcaattcgatacaatcactaatctgagacggtacaaggcgatgctgggaaacacacgtagtttcattgagatcagcagggatactattctgtcgcagggaatcgataagctcgtgacaatggttcgctcaacagacaatgttatagtcggagctacgagcgtagttgcttacggaatcacgcttgatgttgatacagtgatagtaccgggcgactctatcgagccagttgttgatttcaatggagtcaattctatggtcaaggcgcgaatatcgcagaacgagttcgtccaatgggctggccgtgtgggccgtacgagacctggcactgtcatattccgagggcccttcacgcatgcgaaggttgacaatgaaacggctcttagattgaccgcgttcaagagcgtcacgaataatgacgcacattgtgaaattcgtggcgtcattttcccgaggagccaactagtcacggccctgaagctgccactctcgttcaacatagcactgtccttgtgctcagagtctgggtctttactcgtacctgaaggggtgagtaagcccccatttgagggaaccttcactctgtctcgtgaccctatagaggaacgggattacaagttgaaagacggcagaacagttgttggcctcaagtacggacttgatcacggcattcctgatatttacttggacaacactgatctattaaaagtgaaggtgaacaacgtcgtgaccgatgaccggtttggatctggaagaggaatatctgacagcgctaaccgggcaactctggtcaagacaagcacagcgggctgggctattgcggcaatcctgttgatcctcttgcttgcgattctcagacaaactgagcatgtgtatttgacacctatcaaggaagagaaagagcagaggtacaccgagctggaaggtccggtgaacagaatggggttccagccggctcttgtgattacgagactgtcggagacaaatgagatagcagaagaagatcttctcgtcgatctgagcggagctttcatgcccattcccggctttaatgacacttatctcaagtctatgctcaatgccagaaccctggaattcaccagcgttagcaatgttcttctgtcaatggtcactgttttcatagcatcactcgtggttgttaagttccctgacatgaggacactgtgggtgaacgggtcgcaaactccttcagctgtgacccgtcgcaaagctggactagtacgagacatgttcatgcgtctgctgcttgtcagaacttccgagccgacttggggtgacatcaaagaacaaacagttgaaatcttgacacttatcagagagcgaatcagagcgttcatcaaggagcagacgccagtcgtaaaagagaaggcatcacgagctttaacagcaagcaaaaagatggttcatgatgggctcgtacagatagctgatcgtattcagcctcagactgaagtgattatcagtcctgacgctgtggtcagtgacgttcctgctgtcgggcgtgtcatggagaaagtgagtgatgtgaaggagactcctttgggaagcatcgtgaagccagatatggagcttggctccgtggtgttagtactcatcaaggcgttcacattcttctttaatttttctctggcgtttcttgtcgattcgttcgtaatgtatcttatgaaggcgtacctggctgagcatgatttgatgaatgtccaccgcaagtatgtccggtctccgcacaccgtagggcagctcgtggagcaagctgtaataaagtttggatttgtaccacccttgatatacatcatcgtgatggcttcaagattgcatttcggcgttgctatcatcatttcagaagtgatactgaaactgaggataggcggtagacctctagtcaatgtggcgtctgattggttgtcacaggtggttaaaaacttgctaaagtcatacggcttcaacctaaaccacagaatatcatttgcgaactacgtggtagtttccatgacgatgacagcattgtcttggtttccatcaacgatgtcgagtccgttccgcttagctaactgggtttcgttccttgtcgagtcgggatattccttgatattgttgatgctgttccctgcaaggcaatttgagtacttccagttgaaggaagtagtttcagatattgtcgctgctatggcagaacctgctagacatgtgccgaacaggcgaatcgtcataccgtctcgaaatgttatccctgattctttaagctcgttgatgaatgaaataatagcacgacctcgtcgaggagtggcttacatcatgttattcccggtctggatattgctgagtgagtctaacccgcgtggtaaaacactgcgaagcgtatatgaggacaccatgagctacttcactggcggacctgatgtagtagtcttgccagagaacacagcctcatgtgaagcagaggatctccagacacacaacatccaaagttcgttggaaaccacgagcgcttggtcgtcatttgtattgggtttcatagtttcagtgtacgctgcctttcttcttggcttactcagcactatgtacttcatgttccgagcgggagactccgtgaccgtacttgtagcggggctgtcagctgcagctgagggtcttccgggggcagttcaagctttgagcgaaaccgttgctgcttcctcgggaaacataacgactgctgttgaagccttgcgagtaggcataactgagtcagccttggaggtcttcaatggcgcttgtattgtgatggtatgtctagtactgttttttacggtaatctgggcattatcaggtgcatctgagcttgttcacacctctagcggaacgtgggtattgtggtttagtccgatcattggaactgtttctacaacccttctccagcgatatgttggcaacctctacggccctgctgcaggtgccattgtggatttgttgatgtattacattgacgtattcttggtagcagtcttggctccgtgtgctttcatagtgtgtctcatcagcgccatgttcgggttgttgacccctctgtggatcttgtggataatctacgccttttggagttatgttctattgcgcagcctactccttgaagtagatcttccggagttgccaattaccagctacgatgctgttcagctcaaaaggatcacacttgatcgagtggagaactcacccttgagcggcagagagatcggtaagctttgtgctgtgcccaccacgttgatgttgccggcaaactacgtaggaaagatggcaattgtggctgaacaacagtcaagagaccctgacttcggaggtctcatgcggctcattcacgatggttcaaggcgattcggttcgactcaagggcaccacattgcctcaatcgcagcggctgaagcagaatcaagcctgctggcagcacacgatgatgagaaagcgctcgccaacttccaaggtagtgatgcaggagtgatcatagaggagattgattgtactgatgaactggctatgggagaagtcagaacagtagcggacgaagacgcaacttccgtcacaacgagagctgatccaggggagagtttgcgtgttgacccagaggagtttctgaggcagacgcggaaacctcgccgagcagctaggagtaggggggacgtcatcaagaaaacgtcgactatgctgtggatcgtccaagttcttgaaacgatgccggaactgattctacaagcaaatagagtttccataggtatattatcactggttaactattatctgttccgcaagcatgcttcctcgcctatcacgtcattgtccaagtcagccgacatgctatctggttgcatcgcagttctgtgttgggcgaacagttcaatcctgtccaagactgttcacagagccgaggaattggctaagtgggacacgaaagcgacttcgagaggtcaggaatggttgaactcacgcattgctttgaggtatgaagatgacataagattaccaaagccagccagtcccgtaacagacctgaacgtcatgatagtgtgctgcttgaatcctcttgcagttgtcgtggccttgcttgtgaactggctgtttgatgtgaattccttgaggttgttgatgataatcacagacggaattatgtccacttccacgcttggcgcctttgtgtggggcaacgtcctgttcgcctgccttctagaggacaagaaacacgttgtcgagacttgttgtagaggtactttgatatgctctgtactgattcacactagcgttggagtgtactccgctagagatccctcgaggagactggctgttatagagactattccttcgcttgtgaatcctctcgatgttgagtttagcagtcagtcgctctcagctttcttggagttacccgtgatcatgaggtccaagacgctgcctctaccgcccggtctgataaattcccgcgcgttactggtggctagctgtcgtttctttggcttcttgagggtgttctcccaggataagatactctgtgtcggatcaggacgtggtggaatgctgcaaggactgatgggcgatgtcaggaacctgcgagtggactgtgtgactcttgacgaagagggcttcctgctggacgatgatttgcagaagctaggattgcttgatggccatgttatctcacaattcgtgcaggcagatgctgggtttgagcgttccggttatgacacggtaatggtagatgttgccacgaatccgttcactttatcagatttcgtgcccgagtttaactccatctcaaatcgtcagaacataatcagctcaatgtcacgttcggtccgcagattaaggtacggcggaactcttgtcatgtttgtcccaggaacttcacttgacctgctatgtcacctgagtgatactttctcctttctgtttgaagaagttgatgtcgttcaggacccagtggttagaggcacgtgctattatgccatagcgtgccggaggctacgacatcttggggagattacaatgtccttggccttgaacaacataatcgtcaccgagaagagcggacaccatcttgaactagccctctcgactattaggagggaggaagacactgctagggaaggtgagttaaggtcacatgtatcgctgacccacatcttaggtccgtacatcttgaaactgagagatctagttgatgtcgataagctggagatgccgagcttccatgtggatgaagacttctcgcatttgtcgcgggaatatcagacctcagctatgcgacactgtctcccgttgataccattgaaggttcaggcgtctgttgattctgatcacaaggcttacaactgtttattctcgtctctgcgacctcccgtccctgacagagagcaccagtctactctggctttccctgtggtatcagcgatgctggcagcgagtgtcctcccgacgtcggtttcatttgatgtgccaagtcagtgcaatgatgcgatgctctttggactgaagcgtcgatatgacttcgcggccccagaggggactatcacaggattccgaaggacgattgacttcatgagtgggttcctcataaagaaagctgttgattataacttcctgcctgtcacttgggatgaactcaatctagaggcaaatcgaaagagcacagtgggctacatgtcaaaagctgcttcaaagagatgtggccagctgctggacaatgaacgctcgctcctcgatgatttgatgacgaggttgaaggctgacccattggatgccaatcatgttttccacgcttcgcctaaggttgagaagaaggaaatgaaggacgcttttccgatggtgcccagactgttcatgtacaagtctggtgaggttagactttgtgaaatggctatgttcaagcgattgaatgacttcatggggaaatccaagcagttccctttcagcgcatcaggtgatatcttcgatagatccgcacgcttggctgacatctccaagaggtttcgtcatcctcgatacatcgctattgaatcttccaagtgggacggccacaagtcggcatcttggagcctggtagcccgcgagatattcgctgacgtgatagaggccggacatcatgaggcatttcagtcacgatattgcagggaggtagcgctgaatgacgccctcggatatgtctggatggccagtgggcatttcatagagttcctgcgcgggaatcaaaagtcaggtttgtgggacacttctataaacaacaaacttgtcaacacaatgattgttatagagcttgtatcgagagcactgcgcataccgcctgagtacgtcatgaacagagtggacctactcgttgaaggagatgacggtatcattgtttgcgaggttgaagatgctgaagccatcatggccatgcgaaatgcggtgtatcatgaagcagggtttccacagacaggggatccccgtgtagtgtcgaacatctgtgagaccatgttctgcagccacggtgtgggcttcaccatcccgcactcgattcctgtgccagtgagacctgctgatgagattctcggacgactgatgttgtccctgtcaagtggcccgttaacctggacgtgggaaaacgccagcagaagcctgtcttccacgatatccgccgctgcgatgttctggtttttgcctgaaattcgcaacctcctaagtgtcgtcaagcacttgtcgccgcctgacgttcatatccgagccgcccatccgagcgagcgatggaaggtgatgaatctcctcggcgggatcgacattcagacgtttgacttatcacggttcgttaaggataggttcggtgtcgaagatgtcagtatggtggacttgtgtgaggctgacagagatgtaatcggcatcaacaagtttagagctctagcgacactccaaccctggaaggttgttctgcccaggtatgtcaatcctgctatgtttcatgaggcgtcagtggaattctacatcggggacggggctctctcagaccgtgtcaaaacgagaatagcgtacgccgagaaggtgtccagagatgccgtcttgagtttcagaaacaagtccatcgcgcgcaggctactccagtcgggtgtcgacatgtcgtttctcagactcgagattggtggcttgaaggagagaatccgcaaatgtcgtgcgcgggtgttggacctgtcggcagatgatctgtctcattctgattctggagttttgagtggtctgaaatctgtgaaggactggcatcatgctggagccaaaatgtcaagagtctgcatacacagcggcagttctacaagcacactgttgttaagaacaagctcctcagtgctggatgtgttcatcgctctcttcgtgttgtggttagctgtacgagtgctgtccttaatcgtggccactgctcaccgcgtggtatctcagactgcgacgagtgtccgcggcggaagagctgttcacagaggagagtacattgtcaataactctggtccggtgctaatgtcgatgaaagagttgacaagatgggcgccgccacgaatggctgaatcaagcttctcaccggatgagactttcctgatggctgccagcttcacagtgccgcgtaaagatcactttctggacacacccaaagctatcgttaatgactgggaatgcctattcaagtacgagaggaggtttgcggttgtgtcactatccgatcaaggcgctaaagcggctatcgtctataaccctagctaccgcaatgactggtcgcaatgtgggattctcgacggtatagtagcggcaatgagatcttttcatgctcagcaggcgaacacggcatccgttcggaagtggaggaaccgcataaagcacccgagtcagtggacgtgcaatgggagcatggtgtcagtccattcgttcaaaggccactcatcgtacggacagatagagaggcccatggcgtcgctcctgaataggctcagaggtgaagggacgttcataatgagaatagctgacactcccgtgctgactctagatggctatccgtcgaatcaatacctgtacggacgacgcaataccaaagcgcggaagagaaccgtgacgggatcagccgtggttggtgagtcctcagcgaagtggagcagggacatggccagaccatacgcccaccgagccgccaataccgttggacccacgaccgactggcttcgaaagcttaatgtgctgttctttcgtggcggagtgacagggccagggttcaaacgagattcaaacgtccgtattaagctggttgaagacctgaacaaggtaatcagcccgctctcagatggcatgagaatagacgttaaattctccagacagcacacacggcctagggtcatgaatcaggaggccgggatgtaccacgctagggatgatatcatgggggattttgtacccatggtggagcagaccaagttccggtatcttttagtcatggaaggcaatgaggcccctgaccgagtcctctcatcgatggccactggttccctagtgattctagtgagatacacacacattctgagccgagagagctggttctcgagcgtgttattcaatcgtgtccactacgtcgaggttgaagctgatgtcaacagtgtcctggcagcgtgctcgcctgtcaacattgattccaacgtgaaaatcgctattgacggtatggtccatgcgagacgattgttaacagacaagaaccaattgtcgttcatgaggaatgttctgtggcagagcaagctgttcggttctatgaacgtgaacgcaggccagaaggtttacatagtgaaaaccacccggaagaagacactgttcgagcccagcctgatagccgcctctaatatcgccgtcctttccaacaacagtagcagtggaacgcgtgagagtttcatctgcctcctgaaggttgacagaacgaagacagcctcccagctgaagaatgagtttatggaaaaacccattccggttgagagagatatgagagcgatcatcgagaaggtgttcgaacgagacataaaagaggaccaccgtggtatcctcaaaacatttttcaaaaccaatccagattggtacaaaaccctgattgagtacataaaacctgacataacagtcggcaaatttgctctatcagatgaccccctaacttatgccgtcatgcgatggtcgagagacgaagtctttccgtcatacattgcgagaatggtgtacattgtaggaacctctcaagttctacgtgaagtgagctttgagaacatgatatgggcggaaggagcaaccccgatctcccgagttgaccagaaggtccttggagatttgggcgtaaaccaccactcatactcgcgggattactgcatagcgtataagagtcatccagtcactggtgtgttcatattgaactacgcttatgtggtcgtcgtgagcgatcccgtccccggtctgttgataaacacaggccaacccatagacaaactgaagtcgaacttagttccttcacaagtctttttgatggatctgtcctctgcctagaagtggcaagatggaagggtgaaattcccggagcaccgacgctccaagcaccaactttgtctttgacaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24 - DNA, 4586 bp, Unknown
  Diatom colony associated ssRNA virus 2
aggatcctatacccccttgtttgggtggtatgtgattccccatgcatgctggttacatgcatgtagagtgtatggttttattgcgctccatacggaagcaatcatggacgggctttcgcctctaaccattatcttccttatgcgccgcctttgaagaaggtgagcataacaggttggttagtcgcagacgtcacagtacccatgtcctctatacgttagaagttatagagggagaactatcggaacacctacaaatgatgtggaaaggcaatgttgacccaaagtggcgcatcctttacgtatcattaaaatataacagtgttatatgttatacaattattactaattgtataatatataataatctatatattaataaccaaaactagttaatatctatcagaatgacagatatcaacaccgttttgcagaacgtacaatctgctcaatcacctaaagcactagccgaggcccttggtattcgccctgggacaaaaggactcgatgacctatacgaacaccgtgaggtgtggtataagttcatcgaggctgttgtccaggcggataacgaaggctcggttagcgctttaggccgcagcatgcaccctattcaggctcttgtttcgaagaccatcgctggtcacaaaacaagcgcccagatagggagcatgactgcagatcaaatcagggcaatattggctaagattgagaaggaagagggaaaataatgtggtgacacattatttcctttcttctctctcaacttagtcagtatggccttgaaatggtccatcttttacgctgggtacggcatgcccagtatcatataaaggtcactttaaaagtggtctttatatgaagctgcattttccacatcattcggttaccgagtatccttacattatacagtttgatttattaattagtcatagctagaatttatcgtgggtttgggaaaccaacccgacgagtaattctgcaatgatctgattacatcaaaccgtataatgtaccagaggtatatgacacgcgggccattgatgttgagatcattccaccttcgggcactcgccctaaggtgggattaaaagggagtactttatctggattggaaataattttgcctaataatgcaacattatatattgctgctgatggtatggcttcaaagggaatggtaacattaccagaagttatacactcaacaaacaatatatttgttgctatgttagacgaaatattatccaaccaaatagagtacaccttagactccgacaaacgtgtttgtttattcgatgtaactgattcaagtgcatacattcataatgtactactacctgtcttgttttactacatagatcttaacttccaggttgaaaaacaaggaaggacaggatctatgaagcatcacaagaaagtggtagcgtacataagaaagtgggcatttgaatctatcacaaaggataaccaaacactcgacggggtcgatctcgacatcgatggctttcctaccaagctggtaggtgtgattaaaggatatattagatgaaggagtaaatcatcaaggctagcaatgattctagcattctatttgctaaacatatccaggcatgctaatagctgctcacgagatgatggatttgtagacgatatcgtctgcgaatctattaaccgtgaaacagttattggcatgtttggatgctttagcggttttgcagagtactgtaaaatccaagtcagaaacttggacagtaccctacaagattttgaagctagatcattgtatcttgatgaatttacttctttccctgatattccttcagtcacacctatctattcaacaaaggcaggaccaaattcgcgcatttgtgcgggtctaaatgctaccaaatcagcgattgttgactcttatgcacttgttatggaagagagaaatctaggtatagctggtgagaagtatagtgttcttgcgaacattacacgtttcagcgactatatcgggataactccgtcctatagcgagtacatcagagaactatctgagcaatgtgttcgtggtggtctaatagatctatccaaatatacatatagcgatatatgtacaggaaggatagctgtattagataaccaagaaaacaaagcacggatagtagcaatcggtgattggttcagtcagtcactactgaggccaattcatgatcatattcatggattcactaagaggtgtatcccttgatcttatgtagataaccagcaagctggtatagataaggttaaggaatacacaaatcttagttcatctaagaatatgcccatgagttgagatgcttcagcaatgactgacagattctctgtcattccacaagacacagttgttggtatcttacttaacgaccgtgagttaggaaggttatggaatagacttgttagctatcgaaattttcgattgccaccaggtatattctctaacaaacctaaccacagtaacgtagacgaagtccgttacgtacaaggtcaaggtatgggactatatactagttttccagctatgaacataacacacatattactatgtggttatgctcatatgctagcaatgctaggttatggccctatacacttaaaccgtgtatctaacggggatttcgttctacggggtgagatcgaacaacgtgttcgtatggaatgacgtgagaacgcatttagacggttcaacccctttggttggatgaaggcggttgctttcttaggagatgatgtctgtcacaaacattccaatacggcttactggaattacattacactgatgaacataaccggtgtaaaattcaatgacttaaaatcacagatcactactgatccgtcatttaaggtcgctgaattctgcaaacgtgttatggttaacggtattaatgtaactccggtaagccctattgtgatgaaactgcttggtgctaatgaaaatatgctagctcttgtaagtgatgagagtgtcagtttaatcaaaggatgattacggttagtcttcagaaatatcgattctaaacccactgatcaacacaggaaagagattagtaaatctttatgatttattaatctactttccgtgttaatcggtaggcgtagaatggatgtcgttgaagaactaatcgtatcctttgattgattgatactctcacgacttagagagttagtatatttgattaacactaagacaggtgcagacattactgacctccaactcattggattcattgttattcaatgaacgttagccaatatgtcaacagttccatttcagctccgagcaatgattcgagagtttatcactccattattggagggacaaactaacgaaatcgttactaaaagaactgacatggagtatgtttcacatactgagctagcgtcatgggacaacaatgtatccgatgaggagagagggtcaacgctatggaaggagctattcaaccgtgaaaagatcaggtactcatatgagttattctatgagataaccaatccaatcacaactgatagcgcttctatagacgacttcttagaaggcaaccaccacatccttggtaggcaaaacccaacactttgttttggtaacttaagactaatgtacgatagaccggagatccgtctatgtgcgatatatgacctttgagaaaaggtcatggtcaagaaatcaacaggtgagtttattgatcaacataatcttaaagataagcaattatcattaagatacgttgatcaatacgctaacgggttgataactgatccctcggatggtaaattattaccacctgagattatcgcatgtgacgaggctctccgagtctattctgagtcagtcacagatcttagcaacaccagccaagtatatgggctatcacttgaagagatgtcagaagatggatttacattactgcaaatctatctatctgagatccttcacgatgctagcctatctactaggaggggtgttgctaggaactatgttggtgatccaagaagattcaatccaatattggacgaagcattcatcaaacgtgcatccaaggtctcaaagtcagttttacactgatttgggatcattggacacatgtctaatgaatactacgctgcaatattagatcgatcttctaggatcacaactagtggagacctgtttatccagtttaggacctgagtatcaactcctaagggggaagaagatatagttagtatcatcgatctcaatcttaaggacgttaatagcaatattaacgtaattaagagtgatatcgagttacaaccattaccgacttccttattagttgttgataataaggattctaaacaggataacaagtctccaccagactagaccagcgtacatcagattttaagttacactacaaagtggtgtcatgtaccaccatactcactaaccgaaactggaaaatgcagatttagtaaatgtaaatatgccgtttgggcatataacattgtccaaattttacatttacgtagcagttagtaaggtctgctttaaaaccaaaccaaaaggctttcacgcaaatacgcgggatgtaagtcct

SEQ ID NO: 25 - DNA, 4568 bp, Unknown
  Diatom colony associated virus-Like RNA segment 1
tgaaaggggaggtcctctctggggaggttcctgctggtcggcttcacgtgcccccttttgtagtcgtggctttgccgcttctctaagtgccagctttctaaaatctcgatctggaccatcgcacttgttccagatagtgtaattgtgcggcttcattccctcaagggttacttccagaccttagggatgattctacccggaaattcatcaggaatttaaacggtttggatcaatctaaacctcttggaaaatctttcaagttaatcggtcttttgaccgtctcctagcaaaacgctgggaggaaaacccgcaacggatgtcctgtgttgttcgggcctcagagcccgaccctccgcctccagtcgattcggttttctctgaatctgaaggggctcccaaggatgtaggagcgaggatctttaagggcttcgtgccccgtaaggacttgtcccctgcaacctcggaagctgtttctggattcatcgagacctcaggcgaggtcttgaaggagaaatcgactcagaagtcttcgctcgacgcgtccaagctctggctctccggtcgcaccatcttcaaaggggtctgggcgaggttgtctccatggctctctgtacttctttcgggaattattgggagtgagataatcttccctctggactttggacctgattccgtcgccgcttttgcggaacgggagaaggtcggttctgcctctgttggtgacgaaccccctgagcttccttttgtgagccgtgagagtgttctctttggtgaggagatctttgagtctccctcctgtgaggtccccggattcggtttcatccctgagggtgtcgataagtggttcgaggtttcttctgatgggtccttgaggccccgggaaacttcactgccttatctcggcatgccttcttctgagatgacttcgagtcctgaggcctcagcgctcctcgcttgcctcgtcacgctgattttccctgatgcggtccctaggttcgtccgggctttcgtcaccaagacttttgtcgaaggtggcggtgaccttgaggggatgtcagttgacgagaggattacggagttctgtttcgctgacggtggtatcggtgtcctgtcttgggacgacactattgggaaaggtcttcgtggggtacgtaagtactccactatggcctcctcgaagctagagggtcctaagctgttcttgagcccagctaatttgcttcggcatgaggttggtctccagtgcatccggattctcaatcagtgatcttctaagatccagggcgctgggactcgacagatttcaccgatccaggctaccggcattcgctccttatttgacttttcagtgtcggtaatccggatccttgtcccatcattggttgcagaaggcattgggcgttccaccctacatcctaggcttcggtctgagtttgggtggctcattcggtgcgtgaccaaggacattgggtctccttcggatcgtggggctttcttgagtagggtcctttccttcgtggctcgggccgagatgcggtatcttcaggagaagggggatgggtattcacctgtcttctttgacactaggcttttgtctgtgttttctaaaggtgggtctacctttaatccttcttcgcctgagattccatcccgtcgtgacctcactgaggttgtgatcactctcaagctcctaggtctgctcggtgaagacttcaagggcgctccggtcccttctttggtgctagaggatggtggcgagttggtgggttagtctcgtgctaccctatctctcctgcccaagcctcggagtatcgtcgtttttggggtatttcttcacttcgggttcaagctttgcgcaattttcgttaccttctttcgcgcgaatctgaacttgtggagagcctcactcgcgatgacctcccttggtgggcgaagctctctaagagcgtcgcgtcctcgattctccatggactggcccggagtttggaccccgagtcagaggttgaagctgttgggacacagaacacggcgaagtcagccgtgactactgttcgctacactccagacatgatctatgactgcactctcatctcataccactactggggtgcagactttcgatcgaaaggtgtgaaggcgtcgaaggaaccttcggtccatcaaacagcgatctaccctgcctccccccctcacagttactacctaggtaggactgggagaagggttggggcacgtcccatcccgaaatcgcatgtacctcggtacacttatgccaaagggatgcgtgatctgacgaatcggttcgaacaggattggtgtgaccaccctggacctcatgcttaccgcatgcttccgccgtctttcgatacttcgaagtaccatctcatgagtcagctctcagagcgattctttctcgaggatcttaaggttcgtcttcctaaggcgatctctcggacttgagctcgcctccctctttgtagggttgagctcccgattcctagatcggtctggagtgtgcggctgggcgctgacaagctacctggtggtgtgtggaatgacttcttttcagacaagttcggtgccttcgggatcgccgctcctattgctgagaaagtcatgggacttatccattctggagaaatctgggatgataggtcttcctacaccctaggggcccggggaagacgccagaagaggggtgacgacgtgagtctattctcgttcggtggaaacatcgaatctaggatgatcatgatgcctgattttgtgtcaagcattgttgccctatgcttcagtcaacccctgatggatgccctgaggttcagccaagagactcgttggtcctggaataagatcgggtactcgcatgggaatcagaactttctggatctcggcaagtaccatggtctcaaggataccttcgagggcgattgggccaacttcgattctggggttcctgtggaggtgatccgggcggcattcgctgtcctcttctcgtgctttggcgacagtcctgagtgacggcgttcaatggagtggtgtttcaacagtttcgtccgcgttaacgtggacgtcccgggagactaccgctaccgtatcttcgggggaattccttctggatccccttggacgtctttggtcgggactgtttccaacatgatcatgcttgatctcatgtcagatgagatccttcgggagaagggtttcgacctgagaaggatggagctcgggtctaagtttcacctcgggtatattgctgacgttggcggtgatgatttcgctatcacccattctgcttcccgtaggtttcttgggctctttgctccgtcagagagcatgggaagggtactctcgtccggcttcttcgaggagtgtcctcggctcaggcctaaggaccccaacgatccaaggtggagtgtctctcgtgggccctctggtccggcaaagcttcttcggagtcctctcgacttcacaggtgagtcggatctcttggtcaaaggcggcggttctggaaagaccctgggcctttgccaacttgcggttgaattctttgggatgcaaatcaaggacgtttctatccacccgtacaacatctccttttacaaggggatccttagctcgaggtcagagttttgggtacggggtcgcgagatagtgaaacgcctaattgctcctgagaacccattcaaccccgaagattggttcgcccagcttctggctcatattcacaaccctgtgaacagggaacctgagctagaattggtcgcctggctggtggccacggtcgcagttccacctgtctgggacgagctcctggaccttggtccttctgggactaaggcccttgagtggtcctactggcaccgagaggtccggaggatggtagaatcccggttccatgagctcatgctcgcaccctgtggtcatgagtggaacttcccggattcggacaagactattggtggttcgatccctgatcgttattcccgtagggatagggtcaggtggtctctctggtatttccggacgacctacagttaccttccaaggtaccgccccctcggcaagcgagtgaaaaggaagagagctctgctccgcctaaggaactcgtttgaccggtgggctgggtccaccaactggcttcgccgcctccgtctcaccaaggcttcccgtccggcacaaggactttcgttgcgcgcggtaccttcaaagtactgcattgtctcagcttaaccgattcatctcccccctctcttttcgaaatcctcggctcctccaataattttggaggggccggggtgtggtgttgggtccaacattgggtgttggactgagcgtgggttatagagcagattgctcgcaccactttcccttttgggtctgctcaaaagctggcttcccgactgccagttctccagggtttctaccctttccctgggggctctccagttaatgacgcgtgactgggttaaagagctatgcgttagggtctttcggacttgtccggaggcggtggattatccgggtttccgccactctctcatcgggtgaccggtgggagagtccaa

SEQ ID NO: 26 - DNA, 4786 bp, Unknown
  Diatom colony associated virus-Like RNA segment 2
tgaaagagacgctcatttgtatggcagtcggatactattctagactgctgtatttctggggtctcaatcctccggacggacgtccgcgacttctacgtgactctcaccgcttgtgcgcgtcttcggatgcaggtgccggtcactccacgggttcttcccaaggtgagcaatcatcacaggaccctggtgacacagaagggcagcttgctgtcccaagtgttactgaacctggcggtcgaaagggaaactcatttcctgagaaggataagagttcggccgcttccgaacaaacctctggctcgagtgaagctggtgtagcctctgaagcatctgtcaaggttgtggctcctcctaaggggttcgacgctgatagctggcgtgcatacaatgcatatatggcctaccaagcaacggcatccgcactagctgcgcccaatgttatgttgcctgtccgtataggcgttgcaatcatgtcagccgtccgcaagataacctcaagggtgtctgcagcatttgatcctgccaagaagcgggagtgggcagtatctctccttgactcacagcgcgcaattttatccgctatatttaggggtatgggttccgactttgtattaccagaatcattctcatcgaagtcgtctcagttccttgaatgggtgaataagcgcgttaagacacagggagaatcgcaaccagtgaaggacatcgaatttgcatcttatgatgagggttcgtttgatcttattgagattctgtcggagttgacggttcctcatgatcagagggaagagtggtggttattaccacagttttcacgttggcttaagccttcggcatctcgtggggagataattgagtttactcagttgaccttctcctcgcaggctgaaacagtcgacctctcgaaactatcacctcgttctcttttctctttccttcctctgttgtctgtgatcgttgcctctcattccgttgctggcgagtccttatgggctgatttagctacgctggacaaattgttcagcatagtgtatgctgctgagtcatgggctgatgcttatgagtcgaatgagttcaagggtgttgacgccgaaatcctcaagggttacgaagaccggtacgctcttgcgtatgggcaactctttaaccaaggtggtatgttctcatggaacactccagacggtgtagcattgcgtgcaatcaaggattcgtttaagaagatctccgggtctactgacgacatcttttcgatcattccatcatcacgtattgttgaacatcgtgcggcagtggatctgtacagaaacctcaatcgcgttttctctgatgtggtgcaagataagggtaattcatttaccgctctgtcacgtgctgcattttcgaggtactgtacctggatactttccatgatgcgtatcgcattccccactcttgctgcgtactctctgaatcttgacactctggatcctactattcgtaccataattggtaggtttcaggctgtaaatgcctcagagggacgttcttctggcaaggagtacatcaaggagtgtgttcgtgagttgtctcgtgccgagcttctcatatgtcttgaacaaggggataggtatcttcctgtccttttctctcaggagttgttgaatgcatatggggatcccgacacagcacaaccactggatgcactccgaggcttgagtcccgctgatatcttgatattacgggaatggcttacggttaatcttggtgttgaaacttctgatctcgtgaaaacgggtttggatttaacaccgggtgctactgggggagaacacgcctagatggattacgtggcgtcacaaggtcatccgatgagtctcgtttcaggctaagccgttcgaaacggcacactggtgttctgaggttaatgacctcacttttcaggaatacccgtaagtgtcgcaagaaggctcagtttgaggcattctcaccgatctcgactgtggcatcccgtttacgccatgagcataaaggtgctattcaggctgctcttaaggaggctctatcattgttctctaagaataaggacaagaaactccacaccgcaactatcccacactatggctatcgtggtggaagaatgcagcccggcactgatcgcaactggtggcgtaaggactttgctgtccaaggtatccatcatccggataatctcgcattaaatgagactgcacctcttaatccgcagtccaagcgagctctctatcttggtgtttgaccatacccaatcggtgttagacctccttcaaagggacagacagcgtcgtcggtttatccgatggtggtaactaacctcgagaaggaatataaccctaagggtgatacctggacaaagccgtatggccctgaggcatactcaatggttcctggaggctgggagacagcgcagtatcacatggcagatgtctttaaggatcaccctaccagtttctctggcttcgagcttagggaggctgttaggatggtccttaacgatattcccaatgtcaagatcccatgtccaagcgttgatgatctacccgttactggcattaaacccgagacgaatcccggaggatactggagtaatgtatcctgcaacaaggcagataccttgccctctgtgtttcccttagcgcaacgcttatgggaagggatatcaaacgggacagtcttgagtgatcccggtcactacaccgttggtgctcgtggtaagcgtgtcaaatggggtgatcacttctatctctggcactggggtatcactggtctcatgtgtaagactcgtgttgtcatgatgcccgactatgtgtcacagttagctcagcagccttgggcagagagcctcatgtctcacctacgcttcaacagttcacatcctgattcctggatcagagttggatggtcggcaaataacttaggtttcaccgatctcgacatctgtcatcgatccgggtttagcgttgagtctgattggaccgcattcgatgctggagtttcctccgagttgatacatgcatcattcgcgattctctttgacatgttcgaggagtctccaatacgtgataacttcgcaaagttctgagcgactagtttctcagagcggcgtgtggttattcctgggggcttcacttacttcgtaaggggaggcattccatctggctctgtctggacaactcttgttgggacactctgcaacatgctcatgctccgaatcttgattaaccggttatcgcgcagctactctggttttgtgatcagcgagtctcatgatcaggtgaacccactcacaaacggtcctctcgatccaaacactgtcactgatcaaggcatccgtgcacgtgtgcatgagaagggttatgtccgtgttccattcacagactacctcttttccactccacgttctaagggtgaaatcggtgacaaagggaagatcgtccatggttcaatcatggacaggattcgttcgggtaaacctactaaggtgcaaccgacggtgcgtagcaaagacgttctgatacaggtaagtgagaactatcctgttggaacagtcctaaatattacacgttcatcgtgtctggaccgttctgagtggaacaagtggtatggctttattggtggggacgattttcttctaactcatccactacaagcacccactcatgtctatgccgtacttgatggccaaccgcagttcatctccgttgatgtcgaagggctaaaagatgttatctcggtaacgtcgaacaagctattctcgatgtcacttaaggacataattgtcaacgatccttcataccattccttctataaggcatgtatggatgagaaggggcagttttatgttcgcggggaagagatcttgaaacggactgtagcgcctgagcgtccacttgatccaatgaagtggattgatcagctcgagggaaagacctcaacaccatctgaaagggtgggggagaggaagattgcagcactaatgttagcggatatcgcaagtgatgaccgactgggaaaagaaattccagttagtattaagacactccccgctgatgttggtctgcagttcaatcgattcctcaacttgctcactagctcatgcaacaagacggtcctatcatatcgatcggtagaatacgcgtctcaaagacacacacgtgaattggtttgacactatcttagtgcgaacccgatgaaccgtgatatacatgtcgagatgtgtgttggctggtggatgacgcatattggtctgtcacaggagtgtgcactcacaatggcacatgacctatcacgccaattatttggggaggcttcacctgaaaggtggcttgcgaagttctatcttcgtatgcgccgatctaagcgtcggctttccaaaatctggcgtggtgatggtaaaacataccacacagggccattctcataccgggcgtacaagtaactcacgagtcacgtagaagtctgctatactcaaaatagcgctggcgggtatggagtctttggctctgtgcccgtctggggacacatatatgataagcgtgtgtgtcattggttggttgggcgctggtaatagggtagggtgtgtgcagagggcagtttaaggtctgcacacattcctaattcgcgtaaacaagtaagggggacgcttatgtccgtccctagcggctatccccggttagtttacagggtatcatgggtcacaagcctcatggtattctcgtgttatcggggcacccttcggggtgtttctccgtccgaaaggactgggaggtca

SEQ ID NO: 27 - DNA, 3458 bp, Unknown
  Diatom colony associated virus-Like RNA segment 3
tgataagcatccagctaactatcgtatcgcgttagtgctagtaggttgcttatactcggagtgtgttctccgatccctttttagggaaacccggagtcaatatgacttcaaggtcgattttatcggcctattcagtgtggccgcaggaactctaaccgctacctccgcgaagcgattacgtgggaccgatgaggagcgaggacgagtcagcgttgcactagtacgaccagggagggttccgttgatctgagcttgtgctaatttcaccggatccccctgagcaaaatttcgattctcttcgttcttctgttctccctagtcgttactagtgtaacgctcgcctacggcctcactcactcagttttcatttatcgtctcggtttcccctccccctacccgatccgaccaaagatggacgacttcgatcccaacctcgctgacggtgaccgtatcttcgggcctgacctgtacactgtgcaggatacatccgcgaccaccccacttctagctcacctagttcgaaacagctcgagtgaggcggtcacgggtaccgacgattacatcaaggtccactccacgttctccaccaggaccgtggtgcagggtgtgcctagcactggagttcgccaggttgagttcaacgtctgtgctcgccgtcctaacgtcgtcatcccccgccccaatgccgccgccgatcgtatcatcggcgacatccccgtcaatgagtcgtaccaggctgacatcacctacgcctcctcccggaacgccgctcttccggcgactttcaagacgatggatcttcgtggcgttgtgaagaggttggcgatgggtatcgcgcattactctttgtgggggactcttgactgccacgacctgcggggcggcggcaacgtggtcgtgcgggctattagtgccgccactgacaacgtggccatcgcccccggtaacgtcttcatcacgaagagatcggctgaccaccgctatggtgcgactgactgcgctctcatcatggctgtgaacggtgaaggaggtacaccctacaccgacatgctgaccatcgacgggaacggagatgctaggctcgtggtttaccgtgacgcggccctctcgcgtggttgttacgaggcgcttcgtctcatcgctgccatttatgatgcggctcagaatggagcggcgttcgcggaggcagtcttcaacgggatcaacgccgtcatgacgctagttgcccacagcgatgaaggagggcacgtccgtgctgtcatgcggcgttgcgagtacgcactccctcacggcgctgttgtgtttggacattcgctgcccgattacaacggcatgccttcgccgagcggaacggttgcgtcgttcaggaacctgactctgtcgatcctgatcggtgcggcgggaggtagtatcgcctgtgatccgatgaccaaggatgctagcggacgtgccttcccgacgattctggtcgacgtcgagggtggcagggagaacccgggtgatccgtctgatcaagcgacttgggatgaccagatgcgcttgaggatgcaggaggagtggatggcgactgcaggtgcgtggggcaggaactacgcgtactacctggctcgcctcttcaacttcagcgggagcaccgatctggccgttgacgccatctcgacgaggatctcgcacggggtctttgtcgatacgcacctgcgccgcccggttgctgttgcttactactgggtggagcccaccggttcgtgcccgatccgcgaccctctgctcccggcgactgctgaggacatcgggccgctagcggtgttgggcgagcgacgttctgtcccggctttcagaggtggtgtggtggagcacttcggcatcggggaagtcgagatcttcacgctcgactttcgctaccttcgtcggcacccgtacttcgtccacctgactagccacgcccggaacggtctgtcacacattgccctcatgtctggcgatgcgtacaactttgccaacgtgggaggtcgcggggacttcgaggacaggttgggtgacgggctcaacacgttttgctggggtcgtcttcacaacatgatcgctgctccgggcgagttggtttcgactaatcgttacgtccagttcgctcaggagaccagcgtcgtgagggctgccactcggaaccacgccgccactcgccgggcaactcacggattcggtgccgacgatttcgacgacttgcctgacgtttcgtactcggtttcgtcgttgtcgatggacagcattggtcctctcgtcgctcacttcggcaacttcgctcgagcccgcaccggcgcggctattgcgattgaccagtgtcgcggcttgtcgaacggtgcgcagtacgcaggtgccttcaccccgacggtcggtgagccggttttccgtaatctaccaggattccgggtccgcgacgctactggccagacgaacacgcccgcccgccaccgtccgcccgtcgagcgcaacgccgcagagacgattacagtcgatgacgtggcagcggttccagcggcgggcgcggattacaacgcgaccagagtgccgcttgtcttgcacaacgtcgctgaccgtggacgccgtgcacctcggcccactcagctggtgagcggcggaggcggcggaggcggcggtagcggcggcggacgtgcaggccccccccgcggtggcggtcctgcttccggaggtggaggcggaggcggcggctcaggctcctctggcacagtttcgttcgccccaggtcactcgggaatgattactgtgtcgacaactgctgcgccgactggtcctgccggcactacgcttcctggttcatcgacggtcgtcccgcctgccggcccgcctaaccctgaggcccaaggaggatcgtcagtcccggcccctcctaacgcctaaggaagtggtgcaccctgacaaggctgagtcgttaaaccgcccgcgcgcagcgagaagcgtatttagacgaggctgagtctcaaaacggcccgcacgcagcgagaagcggaacagtcaacggagtgcgactcaaaactctcccgtacgaacctagcgctgaacgagatcagcgttagtggctagcaatctgacggccgaagtcagacaacgtgcctgtgcgctaaacaggtgtgtcgaaagaccgtaggagtacacaagctcttaggattcgtcctaccacccagtgtagagctgggagcaaggccaagctacaaatgagccactcagcgtgacgtcgctgtacgttgagttcactagcgacccccgggaggtgagaccgggcttgatggaaggtttttcgcagagagcgaggccgtcctggaagtcctagagtgaaacggtgtgagagcggatgtctcgagcgctttatcacgaagggatggaaaggattggctgagcgtggttgcggtggttgatgcaagtggagtgtccacttggacgcg

SEQ ID NO: 28 - DNA, 3190 bp, Unknown
  Diatom colony associated virus-Like RNA segment 4
tgataagcagccagcaaactatcgtatcgcgttagtgccagtaggttgcttatactcggagtgtgtcctccgatcctccaaggaggaaaccgggagttttataaactccaaggtcgtttattcggcctaatcagtgtggccgcaggagctctaagtgctatccccgcgaaacgattacgtgggaccgatgggaaggatggatgagccagcgttgcgctagtacgaccagggagggttccgttgatctgagcttgtgctatttcaccggatccctctgagcaaaatttcgattctcttcgttcttctgctctccctagtcgttactagtgtaacgtactcttgcggccacgaccactcaatttttatctatcgtctcggtttcccctcccccaagcctgcactgggcatgagtgtccggcctcccgaccccggaggcaccgccggtctggtgggcgaacctccatccagacgtcgattccgaccaggagaagaggtggttcttggcagggtgagagcactcccggaggaacacctgaatgtcgcgaccatggattcgtacgctgaccagaggaatctttgcggtcgtcttcgactactgggagtcacattgaacgatctaaacattagtctagtctctacagaccgatcagctaggatagcggagcgtgtcgacgagttagggagtttcggtgtcggcttgttagaggctctgccgttggaggccttgtacgaccccgggtcaatgtcgactgatgtggccgtgttttctacgctattcaggcgcggaaagcggctgtccgctatggcatactcgatgttatctatggagttcccgatgcaggtgccgggcgacgacaacgacgtattgaggttgttcaacgtgggcgtacctacgctatcacggggcgagcctcgacctgtcgccatctgggaccgagaggcgcgtaaagctgcatttcctcttaagagtcacccgggagcgagtaacaaagtgaacgtctacttgagtgaggtctacttcagtaccaaagcagtaaacccggccgtgactgacgagtttgtgcggctgtccggtcatatagcgggtacagcgtctgatgatcaagctagcggaatactactcgccgcccacgcgatgagtaatgttgtttcggagccggtcgacaaggccatgaggctattcctgaatctggaggcggccaactccttgacgctgtgcatcaaatctctgggcttgaacgggacgcttacgggagggtgtctggttgaaggaaagacactgcaaggcagaggcctcccatcaaaggtggcgacggactggcggtaccgtacggatcctgaagcggtgcgggccaaagtccatgatctaccgcccgacaagctgaggtctgcaataagggaggtgatgcaaacggaactcccgaaaggtgagatgtcattcccttcgcttgaggagacgtggacgagccggtggatgtggtgtatcaacggagcacattccaagttgatcgaaacactccaccctgagttagcgcgatcatctgatgacctgctcccgggacaagtgcacaggcgagtcttcgctgaatctctgaaggacaacccaatcctcgaatgggacgctaggagttactttacgggatccgacaaacttgaagcaggagccacccgagccatatacagtggtgattcattatcatacttcgctttcgaacacctgctaaggccggtcgagcgagcgtggaagggcagaagagtgatattggatccaggcgagatcgggacatggggtatgggtcgccgcatcaagcgaatgaggcaccagggcggcgttaacgttatgctcgactacgacgacatgaacgcgaggcacagcctgggggtcatgaagatggtgttcgaagagcttgttctgcacacgaagtatgatccggtcctgggtcaacgacttgtggatagtttcgacgagtggtggatcaagagcccagaggatggtgagctggtcaagatagctggaacgttaatgagcggccacagagccaccactttcataaacagtgtgctgaactatgcgtacatccgggtagcatcgtcaacgttcgccgatatgcaatcaatgcatgtcggtgatgacgtatacttgttggccccttcgtatcgagcagcttacgacctgctggccaggtgcaaggcggctggtttggcgatgaacccaatgaagcagagcgtcggcgagtacacgtcggagttcctacgtgtagcctaccgccccacccgatgccaggggtatctgctccggtcggtatcggcttgtgtggcgggcaactgggtttctgagctcaaactcaactacgaggagggactcagggcgatgataggtcacgcctggacgttggctaacaggtcgaacaactcggcggcgggtatggctctgcgtgcatctttcaaaaggatggcacgtttgacgggtgccgtggccgacaagctaataacgggcgaatgggcgttacctggcgaggcagcacgctataaaatggaagacactcacgtagtccacatcgactggggcagacggtcgcaggtgagggaattggacaaaaagatatttcatatggaacagtctgcaacggtagactacctgtcgtatcatacgactcctatcgaggcgttggctttgacggaacttaggacctctgttgagagggagatgaagcgtgcttcatacgggaagactatggcctcccaactcaacaaagatccgagcgatgttgaaccacttcgcgctagggtaaaggtacgaccagtcaagggcatgttcctggttcaagatatctgggataaacctctgatcagcggggtcctttctcacttccctctcctgcagttggttaagaataagattcgaagccacctgttgtctgatctggtccactctgagactggcgagtggttgacggggcgccgttgttacgagagggcatggggtacgaagaacacgggggcgacgtttaggggccgaataagctttgctgatgccgggaggatatcggcaaggtgcaacggtcagctggtggacgtgcactacccgtgctttgtgtaagcgaacggcttacaaaataatcaatttacaaatctgaggtgtgatatgcaccgcaggcaatcgatattgttcctaaacggaactttagca

SEQ ID NO: 29 - DNA, 3262 bp, Unknown
  Diatom colony associated virus-Like RNA segment 5
tgataaaatgtaaatccaaacaagcgaacatggaccaatgtacaccgtgctagctgaaaacaagttcacgcacaccgcacagatctgagatctgtagactaatatgaccctgaaaaggttgcattgcattaaagattattagtggtgagaatgagagttgacggggaggttcctaagatccgaattctttctattcatttcttgggcgacctaaagcattataacgcttacaatcgtaaaaaccctccgtttcctcatcattctcaccggtgtgattatgaacttgtctcaagctcttacaggctcaggccttaacgaaagcactcccccccccctcactaccgaggatatcttgcaccaggcgattgaccaagctggcggcgctcgtattgatggtagtggaggcggtggaggtgttcccattgattcttacgatgagcaagccatgcttactcatcctctggtcaacttgttgtcggcatctgtcggggactcgaagccgatgacgttacgccagcagcgcgtctacgtgtctagccttgagaccgtcgccaagctcgacaagaagaccagtgtgactgtcagtgagatcgctcacaagttggaatgcattaagaagatcaacgatatgattgcaggtgattatcgcaagtctggtggagttgcaatttcgactcgttttacgcaggatcgcacgactgttgaggcgactgaccgtaggattggagttcgtcaaggcgtcacagctctaaccagtgacttcagcgcctgtgacgtttcccgtcttgtcgagcgtttgtgtgccgctgtcatgaggtacagtcagtacaaagtgatgacgttcgagatgttgagtgccggcaacaccaacatcaagaatcgtgacaaggttgatggcaggattgaagagggtgctggcacgttgtacatccccagggtgacggctcgtggcggttcctctgcaacttggtacgcggcagttggtggagcacttgggtgtggttcgaacgttgtgaccgactcgacagccacggacaggaacaaccgtgttgttctgagcgctccgaacggtgcagaactcgtgctgggttgcatggaggccgtgttgcgtatctggaacaacatggctcactgtgaagctggtgtcattgcaagccatgctgcggcgaaaggcctgcatgatgagatgtctgtagttggacacactgacgaaggcggtttcatccgatccgtgtggcggcgcaacaggtttgtggttccatacggcgtgttgtggttggacggcgaaaggttggcttcgatcccaatccccgcaacggtcacgcctcggagtgcagccaggtggtgcgatgccatcgccatctataccgctgcctgctctgcgatgtgtgatcccatggttgaacacggtggtcagatgtatccgagcatctttgcctctggggtgactagggacactgttgccgattacaccgaagagggcaatcttgatgctatggcaaccgaccatgccaacaagatttcgtctcacagcatgacgtggtgcgagaacatggccaactgtcttgataacatggtgtcgctgaagagcagcatggaagccaaacgcgttgttgcaggcttcctccaggctggtttcgacacgttagcgggtaatgtcgataggcatttgcgtcataagactgttgctcctttctactggattgaaccgcaaaacgtgttgggccgtgagattgccaagactgacgtgcagatcaatggatggggagttttctcttttcgtggtgaaactagggagcacccagcgctcgaaccaggttcgaaggttcttagtgactcaaatggtctgtatgcaaacatgtacataccatttacaggcgccaggcgcaacttgttgtttacgcatctcatgaacaacccgaacgatggtcttgcatcgatcctcccgaggatgacacgcgaagacgggctggtgctggttggtgcaacggacagtaatggtggcagtttctcggagcgcgcggcagcattcgaggatatcggtaactttatgtggcggcatgctacttgcagactcccagcccctgctgaattcatgcagttggagaaaggcttggcggtcagaattgttgtcggaaccatgagcaaggagggctactataccaagatttctactggcagtcctcaagactatctcgggaacatcaaatgcagcggcacgcaaatggtgggtctgggtgtgaggaataggagcaagccgttcacgcgttcagtggtgcgcacgcaatcacacgcaatcgcgtccttgcagaccaacaggggcattgtgcgtggtgaaaaccccgcgtttgtggaacttccaatctctgcgacaggggccatgccaggcatgaacattgtcgaggaggcgatgagcgacccaagacggctccaagtagttggtgaggaggtgaactatcgctgggattcgattgtcggcagagtccaggatacagttgtttgtcgcgggctcagacatcgtcaggtcagtagaggcgaaaagaaggtgatgcagacgccaggccctgccaaggaaggaggtttacagcttgaggcctttggtgatgcccctgaggagagtctgaatgtggttacttcattcatcggcgctcttagggctgggtacgatcctgaagctgctgatcccgaagccgtctttccgcgagacgacaatgatatgattcgatttgctgaggtcaatccggccatgatcaaagacaaccttgtcaagatggatggtcgagacagcgcagaactagtgtcaaccatagctgctcttaagaagcatacagaccgcaccgtgtttgagagcattggtataggtatacagaaagagaacaactgtgccgaagcagtagaatgggcactgatgttcttcgcagctgaattagcagataggatgcaggcaggtattgacgttagtacggcctttgacgacctgcttgcagaacatacaaaagaacaggacacagataatgattttcttgatgaactcgaagaggacgatgaggaaacaacattttaagtaacaaacacataggatttgatggaggagggatataactcaaaatcggaccactaatatatatttagtaggatgcagccatgaaggtgagtagattaaagaaacgtcggcgattcgacgggcttgaattaatttacaagatcacaagcagcggtaagcgtcctaaagatataaacgtgcgacgtcacgtttaactca

SEQ ID NO: 30 - DNA, 3325 bp, Unknown
  Diatom colony associated virus-Like RNA segment 6
tgataaatgagtcaacgtcacaactggacacggaaacaagaaagcgattcgcaccctcgtctccagtgctggcatttacacgactcatagtatcagctgattgatcccttagctgcatactgaacgcgaaccgggcggtccgcagggtgccaaataaacgagtgggaacagctactttgaaaggttgttgtttggcgggctgcacttgaatccaatgtggtgatggttgggataatgtacactagtcactaatgcggagacgtatttaaaataatatcacagttgaaatgcgtaatatgttaagcatattaagtccgattgtaacctgaacaaggccaacttaatcggatgcgcgagctgatgaggcgatcgagggtgccgaagacatcaattctaaagttcataacttcggcactcttaatggtagcttatctcaaagccataaaccatcggtcgccttttggctcgctgcatatcaactctgaaacactaaagaaacatagcctcaaggctcaagataactctctcttcccctcatttcgtagctgcctcaggaagtacgatagcacgggcgaactacttaatgcagcagagctgcgtgggtcagagccctatggtgaaggagcgctggctaggttggcagatgaaggacatgctgctcgctatcaaccagttagcggctcgcgtgaaggaaaacttcattcttatgccaactgggctcaggtacgtgcaatctcaggcagcttgtacaatgacttgtatgacaggaggcacacagggagagttatgttgcccgaacgtgagacagtaccaccgcaacagatcagcgatcgcatcaatgcatacggactgctaggtactaagatgctgggcatgttgaggagtgaaggtattgtgtctcggtcggttggattgcttaggcagcgggatgacgtgctcaccttgctcaaaaggaaccagaggctggcagtggcatactcgctcatgtacgcattgatcccagtccaggctgtagtggacgaagacacgataatctggatgctggaaacaacgtttggcgaagaaacgtacgatgatgaagagaaaactctggccaagaatagtttaccgatcagtgaagaaaagaagcacaaactgttcaagcccaagaagcacagatccgttgctaacagaaccaatgtttacttcacggagctgtaccagtcagcaagaaagctgtcaaaagcgttttcacagctgctcgacaaacaaagtgggctggctgagaatctgttcaatgaccaggcctcagcttggcttatgtttgctttcttcctttacaggcgcggcatcagtggttttggtcacaaggctgcgatggcattgaggcatccagaacgtggcaaacagctatcaacagcaatcaaaggcctcggggctcaatatggtgtgttggcggctggtattctggagaccgaggtgatgcaaggtcgcggcacaggagaaatcgatcttgaggagaagatgaaggagagaatggattctagaaatgcaactctgaaagtcaacgagcgccaattacgcgaggagattgcgcgagtgttggatgaggaaatggacatgcggaagtaccaatatgaaactgttgacagcttctggacaaggcgttgggcatggggcgtgaacggttctcatagcaaggttctagagcgagaggaaccacagtggaaagtgaatccgcctggactgaagcgcttgcatagacgggtgtatctcgaggaagttgacttcaacccggtgacgaactggagtggagaagtgtatgtttcgtgcattaagaaggttgagacgaaaggtgagcgtgatttgcaatcgatcgatagtaattcttacatctgttttgaacacttgatgcaaggtgtcgagaagtgctggcgcggtaagcgagcgataattgatcctggcaaaggcggaaccgcaggaatggccaggcgtatacgttcaatccagaatggaatcaatggagcgaaattgatggttgactacgccgggtacgacaagcaacatacgttacttgcgcagcagttggttgtagatgagctgtgcagaaagattggttatccgagcggcatgtcaatcaagctgatcgaaagcttcttgaagatgcggtgctacatagatggtgaattcaagggtatctttggaggatcgttgatgtctggtcatagattgacaacgttcataaacacggtcttgaacttggcttatctcaggttgcattgcccggcgatcgagaaatgcaagagcatgcatgtaggagacgatgttttcgtggcctcgccggacctgaaaactgttgcactgattgcagagcagctcgagcattcaccaattgtcgctaagccggagaaacagagcatgggcacagtcagcagcgagttcttgaggatgtgcacgcgcgggacagtgactcagggatatctatgtcggagcattgcctcatgcatcatgggtcaatgggtgagcgacgtcaggttgtcaccagaggagggtctgcagacaatgatttcagctggctggactataggtaatcggagtagggatatcgaaatggccgatctattgctggcaagtgtatgcaggatcacatcattgaatgcgacagtagcgtcaaaactgttgcaaggcaaagcagcgcttaatgatggaccgtcgaggctggaagggatgcactcggaaagctatattgttaagtttgacagtaaaattcttgccgacagcaaaaaacatgttaggaaggcgcgtgcagttaaggactacctaacagagcatatccaggaggaggataggaacattctaagtcatatgcaaacatcagtgaaggcagtgatgggggatgcttcatatgagaaatctgagaaggatataagcgccggagcaattattgaaccggttgtgcgcgttcttgatcacgtcgttaaaggtgtgtatacaggaacaaagctcagtgaactgatgttcgcgagagttgagaaaggggtgttggaggacaacccaatcttgaatttggtcaaaagacaaatggacgttgaagaactttcattcgccttgcttgagtatggagtaggtctaactggttatgaaacttatgaggaactctacagaaaagcatggggaactaagggactcggtcgagccattttaggatttttgccatacggagaagcgtcgggtcttgctcgtgcgtgtaaaactgattacatcgtttgtggtgaattagcaatatacgcctaaagagagcaagaactagacgctgcgatcaagttgaatattaaaaacttatacg

SEQ ID NO: 31 - DNA, 1986 bp, Unknown
  Diatom colony associated virus-Like RNA segment 7
agtttaacttcttatatagagtcacctactatataaactttataaaactactatacgtcgatacatagtcttctcacaatgtagaattaaccaaccgtatcacatgacaatcttaagaagcttaagccagcttcaaaagaaaagtcttacgtcctcctagagggcaatcttagagctatccactttatttttgctatactgtgtaggttttatccaagacaatatttacaatagattactgattaataccgtagatctagagtcactgtagatgcattagtctaggatttcctcgctttcaacgtcccacccccacctaatccttgttaataaacatgggattagtcaataaacatagtgaagaatttattcttccctagtttcaaatggcgtgtcgttcattttgctgatacaaggtattatccttggaatcttgctacgagcgcagaatacccattttcacgggacaaagatttagcatagaagattaagtaagcttacgaagaaggtactttaccaacttcaaaagttaacaaataaaacgtcttcaattatgcttatgtatagaataggactttagttcatcaaatcaaagcaggcaatgtgtattggaagaatcttgatttagagattaccgcacattcacgcagtcacttagttaagtaagactaagatgacaaaatccgaatggtattcggaatgccatgggtctcattaatgattgaggcaatgtttttctttccctatttaaattggttgaggaattccgcttcaccactattatggggctatgaaaccatgctcggaggtcatcgcagactcgataaatttgtttaaccaggaatgatattcatcatgatagactggtcacaattcgataaacgcgtttacttcaaattcatggatgtattttatgataccatcaaaacctgcatagattttagtcagtatataccgactcacgattatcctgagggaaaacccacttctgccaccaacttgtaacgtctttacgacttcatggtttggtttcagaaatatggaagggttagactcccagacggatctttgtggaaaaggatgtatgctggacaagcatctggtaatttgataacataggtaatggattcattcgtgaatctattgatcctttgttatatcctacttaaagtaggtttaccagtgcgcttcgccgaacccgaatcttctgatttctgcttcgtactcggtgatgattcgtatcttggaattaaatttcctgaatcaagtcttgaaaatttagactccttactaaaacgtatggaataaattgctctataagatttgaattagaaaattaacttccggaagtcgaaaatcacaagagatcgtggcgataaagaagtattaggttacagttagtaaaacggtttacccgttcgtaacgttgaaggcatgatagcctagctcttatacccagaacgcagaattaattctgcaaaattaaaatcgagagcattaggtttagcctacgcaaattgcggtgtagactacacgtttcactaagcatgcgaagagatttggaagcagtttccagatgaagaagtgtaattaacaggttccgagttcttaatgtacttgaaaacctagcatatacttcctgatctaactcagtttccccaggcacacgcactccggtctcgtgcgtaaagcttatagcacaataatgttagtacgccattttggcctacacacatattcaaagattaagcttgaaatatatatcccacccagaaataagatagtaacttaacagataggttagttttagatctacgtaaaagccgaagggccaagggcccgatgttccccacacgcttctaaacgtatggcaaacgtcagcggcctagatgttgtaggagtccagtttgaccaccgcttcatcgtcaccttgtacccttcaaggcgttccagggacccggaaatatatggaacgtaatagtcccc

SEQ ID NO: 32 - DNA, 20 bp, Artificial Sequence
  US-comp primer
gacgtaagaacgtcgcacca

SEQ ID NO: 33 - DNA, 20 bp, Artificial Sequence
  U2-comp primer
tggtgcgacgttcttacgtc

SEQ ID NO: 34 - DNA, 1158 bp, Unknown
  derived from dsRNAs of unknown virus
gtataaaattggccgtcaagcagtgttagttaatggcttacgtgtgtttcaacaattcaattccagccgaaaattactttgcaatttacaagagcaatgaccaatttagaatcaggattaacacagaaggttcagtcaaaaatttgcctcttaacaacgttactcatagtcgtgatattattggtgttatcaagtatcatactcagtatatggggttaagtactgtatcagaaagcatctccttggacatgaatagtattggaaggtctgtccactttaagggtaacccgactatgtgcgtaattaattcaagcatcggtccactattcgttaaaaaattaaacaatgcttcatgtcacacctgtctcactaactatatagtagctggaggttataatgtattggcagatatgtttggctatattacgttgaaaaatgatgaacacttcaaatacggattgatacttgagcaatgctatccagttaagcagatagatgtcccgaaaatactagccgccttacgttcattgaattcatatcacgttaaaaacaacggtttaatacatggtgattgcaatccaacaaacatactttgtgataaatatggcaatttgaaattagttgatccagtgaacttgattgaacagagtgtacggtataggaacgttgattattatgatgacctaatgccagaaactgaattacaagcatttcttttttcatgtatggagattgcagccagtattcatgaatgtgaattagatgaattgagactcgagatgactgaattttccgactacccgataataaataaaactaatgggatacggttcacatcgatattcagagctgaagatgactacaacctcatcgaaattgctaagaaaatgaattgtaaccatcttaaattatatgaagaagacaaaacttacgatgacgattatactgatcaaattggtgatgaaattgatgataattacgatccatccgaactaaataactatgatgatggtgacgattgagttagttgaacgcaatgctgggtcgtcaggcggtgtgatgagtgtagactgctactgcatgattcacatctcttggcatggggtgtggtagccctgtcgactaatatgatagctatgtcctttttaaaaacagacc

SEQ ID NO: 35 - DNA, 1584 bp, Unknown
  derived from dsRNAs of unknown virus
ggtataaaatttgagacaacagcgagaagatgttgagcatagatagagcaacctctttagtgactgagatttcatgcatggttcaaagtttaattggcgttgatgaacatgctaagattctaagttacgatgacttaatgaaaaagataggctacatgattaatgctgatcaaaatttattcattaacttgaaagcttcgatgaataaccctagttttgtagagaagttaaaacgtataatcacgttgcatggtggaataaattctaaaatgcgcattacaatgcaagggttcagtcatttaattgaattttgtagaatatttgaactaccaaaggatgatgaaatattgcggttattgagtttcatggtatttgagatttacagcaagaaagcttctaacgttgaaggcaatgttgtaaagttcagtaagcttcatgattacataaagcaagctgattattcagataatctgtgttcgaaggaaatcaaaggcattgctttcattgttgttaatctacggtgtgccagctatatttgtaaacatattgatgcgttcaagttgagagatgaagtgtatgaagtgaaaggccaacggttgatatcaaatcaatttggatactttaaaacgcagcgtgatggatgttttgatgcgattgccgtaatgcattgtgtcacagccggtcaatatattgtcgattttgaacgtatgaaaattagcataggtaaagatttgtaccgacaattgttggctgaagttaattgcatatcaaaagtcaaacgcaagttggatgaccctaactctaatgcaaaagttatttttcaaggtgtaactaaatatggattcattaaaccagcttccgacgataagatgtataagttgaataaattgcaagctgccttacatgaggtgaacaaacgtatcttcacgaatgcaggttctaagcttttgtataattatgacagatgcttgattgactacattgatgtgagtaaggctaatacgcgcagctgccgcgagtcaatgaacatgtctgcaattattgaacataggttacttcattacttcaatcttgggacgaagtgtagatcaccaacttgcgctaaaactggcgtacttacaagtgaagcaattgaggcactacctggtagagctgatgttaagttagttgacgtgatgaaattgcaagctgaagttgaaaatgacgtagatgatggagctgaagctttgcattccgaacgtactgagcaggagagactgatacaaccaaattcatacacgtacgtttcatcatccgacaaagggtctacatcaagtaagcttagtggatatacgcgttcgagtagtcggccgaagacatcaaatgatataagcagtaattttattgacgcattacattcaaccgtcaacgtcaataaagtgagtggcaacagcagtagcatgaatgattggtaatcactatttgagtcgaggttctatcctttacacgggctacctggtctgcccagccggatgccttagtgtaatggcaatagtacagatatcgcgccgccttatcagcggtgtccttatttaaaatccgacc

SEQ ID NO: 36 - DNA, 10753 bp, Unknown
  derived from dsRNAs of unknown virus
gagatataaaacataatcattagaaagtccggatctcagttctttctaccaaaaagcatatcatggacatttggcaatttattttaattttcatggtgctcgctatcattggtttagtagtatacaagctcatcgattcatcggcgaccttgatatcgcagtttaacaaaggagtattcgatcaagttggcttagctaacgagaatgtcggaggttccaagttaagttggggtcctttttcagtcgggacagataccgctaagtaccgctacgccggaagcgaacagcttacatagtaatagagatgagcaagtttgtgcatctttatgattttaaaactcttaaaacgaagtttgatgtcagggaactggtacacccggatatctacaaacgttacaaagagaggtcttggtcgttaattcagcgcgagaccaaagtgtttttattctatgctcggtttgaaatcttcaacaatccgatcactattaacgattacctattcggaggcgcatacacggactctggacttcgtctgaagtacggaagtccgttgtctgcgcaccgattcggaggtggcctagatttaaaagtaggtacaatgtcgtctagtgatatgatggacagggttttagcctacaaggatgaaatcaccaatcacccctttcttgctctcagattcgagaaccccaagatgacagttggcaagtacagggactggttacatgtggacaccctcggtcgggtcggacacatcgaggtaatcaatcctcgaattcattagtcataactaaaacttaaaacatggcttttttatttccaggtttaatggcattgctattaatcctattaattgtattcgttgttagattctttagaaaagcagcgaattggaatccaatccaaagtgtcaaggacaagatatcaggatggttcggtggcagtagctcagacgcttcaggtcaatcgacaggtgttagcccatataagccagcaccaacatcgcctattaggacaggtggaacgagtaacgcgtttcaaacagttgcgaattctccgttaaatccgctttttccgataagtgcaatgaacgacgctcttactggaggaggtttgtcggctttaaatccgtttagacgataatgtttgctctgatactgattttaatccttgcttaccttgcttacttatggtacaagagaggtgggaagaagatgctaagtggtatctcttctaagattggattaaatggttcgacaacggtgtcgtacggtaatcgaacgtaatgttacgatcacaattagcccgttttctcgctctgattctcagaaccgcaaaagtagtcaaaagtactacttctggttctgtagatcttcgcgatcgagagttcttcatccagataactccagaaagaggcacctccgtctattttgtcacgaaagtcgacagaaaggacgcagctgtagtctcaaaatgtctgaagaacgcggtcaaagagaacaagagctaaatcttaaaaacagtccaacaatatatgagctatgaaatatatttttcaaataatcacaacgtttctcaataaattagacgggacagagatcagcttcaaaacaaaaggttttgggagctttatcatcgccgtactggtagtatatctatccaatgagcacgctcgatcgtttgttgagtatatcgtagttctgttgttgaacacaatacttaattgaatggacagatcatccaaagagactctccaagtcggtcaggcattagccgctgatatagagggagttaaacagataattggcgaggccgctgctaactctatgagcgcgggacaagcatcagcttgcatccaattggctactacaccaggagcattagacatgtatccaggtgctagtggattagagaaactaaataacgctatgacgctttacacccaggttcagactcttcacggaactgcaactttagatcgtgttcagcagagaagcatggatccactaatctgcgtatgcggagaggaattgaatacgttcggctataatatgatggctaagactaattcattagacacgtggactcagtctaacccagcttcgttaatcggggctgttactccggtcttattgacctccgccgtgccagcgaaagttttcgctccggcagacttcaacgtagtcggatttcaaataaccgctgataacattgacatggacggtgggccaggtaagatcactattgacgataccgaggcaggccttcagtatcaagtgaaagcagttgacgggaagatcagatgtgtgtacttcatgcacaaaccagagccgtatattgcagttgatgctacaggtactagcgtacaaacatcgactacgaactatgagtggactgagttggtagatgatgtgaccatcacagcagatgccatgacagctgaggttcgtcctcttgcgtcgtcgttagtgctgtcttctcttattgagagattcatcgcagtgccgagttacagcttcgaggatcttggtttagacatctatcaagccagccttacaggcaagtgctaataataataatcaatcagaacgaaacctccctgatggggggtttctttcacaatattcatacacatgagtgaaaatgaaaacatagaacagggcgcctctgattacagctggtggaatccctgggggtggttcgatgacgaggagttatcggaggtttcaataccagaatacaccgaagatgatgaaggttttcttgactacctgacagtaggtttcgatgccttatatcttacttatttctcccgcaagtacgggtcaaaacccgcgaaattgcttcaaaagtttatgacgcataacattgacgcgttgaagggtagaaagggagtaggaggcgttgcaggagcatggaaaagagtttctgcagttccagcattgtataacaagatgatgaccaagatagccaaaacgattccgaatccgacgggtttcttcgctaagctcgcgaaaacgagaacggcgtggtcatcggtcctaacgaacagcagattagttcgagcggggtcgaaggtcggaaaggcgatcgccggctcaggagtttacaaaggagcaggtaagatgatgtctagggtcacaagattgctgagattcattcccgttccacagatgaaaattattgtgggtgtggccgaatcagccatggctgtagcgtcagtcatcgacatttacgatttcttctcaggtagtgacgaagaagagattgagaagtacgaaggggctatattccaggagaccgattctaagatagagaatatggtatttccgtctctaatgagtatccgagaggacaggctgcttacgaatagcatggcgtccgatatgggtaatgccgtaaccgcaatggttaaaggggaaaggctgaacgaaagacagattaagcttgtaatacaggcgttcgatcacacatctcaattaggagatgatggcgcatcgaagtccgatatagccgatcttatgcttatgcgagcgatcgcgaataagtacgggatcgcttttacagtagtcgcagatcgtttcggtagacatcgtggagaacaagatcccgatgttatctcaggaatagatgcggccttggtgaagatgttcctcatcaaacaggacgcgttcgacgacatgactataactctttcaaacctctatgaggaaaacagagctgatctttcaggttcagtaaacgcatcattcgcaaaaggagctgggtactttgtggatgacatacgaactttataaatgttcgagaaacgagaaaaatctacttcggatcagccctctccatccatcgatggcggtgtggctggtctcgatttagaccacgacaaatcagccctcaccgatattaccgatttaggtactgcactccagctcgcacgtactcggttcaaagagggagtgagaaaattaggtcttcatcgtagcgatggagtcaagccttactttcacaaacttgttacaactatgatgagcacagggaagcgtaaacccgccgacactgtgatatctttacttgcgaccgtagcgtcggtatcgtcggatgacaatctgaagtacttaggagcaggactatcttttcaggagatagacgagcttaaagagagactttttcacgcgttctcagctgaagagctgaaatcgatgggagtatcaaccgaggcagacatgaatcgtcatccagaaatattgatccgaacgttgttcggaaaaactttagatgccgaagacgcgtcaaaagacgatctgatgcgtgcgtacactaactggttacgtacaattttgttcggttcgccgaacgtcaaggaccttctaatgaggttaggtcccgatgcaatgaaaattttcaaataataaataaatatctagaagtattatgaagtacaaaaagaaggatgatggaaaaacatccacgaagaaaacgtccaccgatgatgtggttttaggatctaaggtcgacaagagccgtcaaggcaagaacgatcagtacagcgccggaatagagtggacatctctgaacatagaaaaagattctattctgaaggagataacgaaagacggcgtctcgaatttttacggcatgatagccacttatctcatggataagaattacaaagtaccgtcggtgtacaaccaggagcttctggcttttgatgtcgcgaagaatgtcgaactaccagagcagctgacagcttccgatttcgtgactcttcttgttgaagcgagaatagttacacccgaatcattaggtgagggtacgaaatcattaatagagaaagctagacgtatagctctggagcgacttatcgcatcaggcatgccgcagaaagaagcaaacgctctagtaattgataagaactttgaggatacgatagcgaaggcttttaaaggaatgacgaacatgggggctaatatattttccgcactttccaatctcgatcacacgaagaacgatttgaattgggtatcatcaggaaacttggctgtcgtagacgtaatgcgtgcaatcggcactttacgagagatatcgtctttaattctagccgcgaccgatgtcgagttagtgaacgacaagattcgctcaatcgcgaaaagcaatacattgattggtgctcttatcagaacggatcatatgttgagaagacatgagggcagtgtcgcattctttcctgcttatttcgtccacaatactctctttcagggagagaaatttgtaagtatgaggacgagtaagtccgaagcagctagaagcacagcatttcaaatcgatagaagtgagttgacggagagtcttcacgccttcacaaagattaaagtttcagatgtgttcgacattgacagtatatcttccgagcaagtgatgaattatgcagaggctctcgaggatctcgtattatctaagcagtgtaaaatgtccggatctatttttgatagagtccaggccggtgtagacataggacagcttcttcagtatccagagttagatcctgttattgctaggactgaatctgtttcaggattagttgatattcataagcatcttcattggctacttcttacggacgcagttttctcagatcagatgtcacaggctccgtacaacccgaaggtgttctatgacaagagagttgattcgaatcaactttccgagattgaatcttacttagcagctatcaacactatctttgagacatacatactagcgggaaagatgactttgtcattaggtgttactcacctcaaagacaggggtcttctctccgacgcggacatctcatttggaggccttacagccatgggattgacgaaaaagcagatagagttagaggctcaactccttcataacgatcagttagttgcgttgttggaacgtaaaaggcaaagattcgtcaagtatagagagataaggagtgacaattggcgagaggattcagcgaccagacgacatgagttattcgtccggtttccattttccgatccgaagttatatatgacgttgataccacaggtaccacgcgatactagatttacgaaacccgagacaatggacgagatgaaaactttacgtcacctgatgaaatcagatgataaggcgtggactatatctcctgatttctcgacgaaatggcagtatctcttcaagaaggatacaatgttcccgacgttgacggcggacacatttggaactctcgttccttccctcagcctcaacaagttgtctagacttacgaagatcggaaaaatgccgagcagtaagcatcttattgacatgcccatccaagctgcgggtgtgttggccgatgtagtgctagaaactatccagaaattcagaagatacatcccaattgatgttttcactgacatggatcttgatacccaacatcacattatggacaacttttcatacgagatagttagagtggagaacgccaacgatctattcgatagaatcggtggttcggtggatgtcgttgagttttgggagaagtacccatcgttcgcgaaattattcttcaggacaccgggcaaaggagacctaatctctaattatttctacgtcttcactgaagatccgttcggatatacacaggtggagattgacgagtcagtaaggaattacaccaacctggcgatactaaatagaaacgctcttttccttacggggaggacagtggcaactagtgttgttgtgaccgacggacttatcttggccaccaagaagcaagccatcgataaggtaccgaagcgtattcgagacggaatcttgcctcctaacagtgcagctgacgctagaatagaaaaacttgctaagaaagctttaaatccagacgagacctccatctcggaaggtgattcagaagaatgaagcttttagagggcgagtatacctatccggattcgactcaggaaaggttagcgaaaaggatgataagacagagacctactctgtcttatcagaattttctcactcttcagaaccatgtcaaagatctcatttctcattattacgctaccatggaggaggtatctcagtttgacgctgacggaataatgggtatgacagcattacccggtttcaagtcgacccattacgcggtcgaagaggagggggtgttgcataggcatgacgaaagagtgacttatgatgactcactcattgacatggtgatgactctttacgatagtaacataattggcgaagtcgaaaagaagaaagcgaaactacccaagggtaaaaacactgggtaccccgatttcatcgctggttctgatagggagttaaacaacctatctatctatctgagtaataaaatcgtagctcaggcaaaagagcagggtgtgtctcttcaggacctgattgagatgtacgagagagagacaggttatgactctttccatggttacggagaaagatttcagaccacttcaaagtttcttcccacgtttttgggaggtaattactttggggagactagattcgtagagagccgtacacggatgatcaactttgtctcaaaagtcatgatcttaatgaataaacaggaagtcacagatatactagccgtattgaagaagacttggtttcattccacagatccggcacacatcgacaaaaagataaactattatctaaatggtagcagtcaccacactattccgttagatcatagcaagtatgatggtagagtagcaggtaataagaccatccccattcgtacggtaggaaagaggatattgatgaagtacttcggctactcagacgccaaagcgtcgaagtggttagtagactccgtttacgagatgggtcgtccaaaaatttttccttatggcgacgaaattctctcgtatggtgggtctgagtacctaccttccggtgagagcgcgacgacaatccacggaataatcgccaacctattctcagtcgtagcggctgtcagggttctcttagcaaagaggaacattgagctaacttccaagaacgttcggaattatatcgggaaagataaagatttcgatgttctatcatggggtgacgacacagtgtttatggtgagcaaaaagtacggtactctggatgacgtaatggcagagctagtctccgcgtacgcggtgcacaaccacgaagtggggatagaaccgactctcaagttcctaggtaaaatatacgatatatacaagggtactccggttcatcgtttcattcagacatcacttaacggtgagagagttaaaactccaggtctatttaagatgggtatggttctcaagtacgagtcgctatcgacggaagtgcaacggttcgttaaccaagacgttcttcggacactagtcgatgatcttaatagaggtttcatgtccgtcaacgatttcggaaagacaaagattactccgtacgctactcacttcgatgttaaggacttcacagtgccaagcagaagagagataatcattaaagagggacttattgaagccgagaaaagagccgatggtatgcagcagctcgattccattctctacttcttgcaccacggagacaccgatagcgatgctatcgtagatcttttagggcaagagatagagacagagttcaccgaggagcaactagaagaggctctcgtcgaaagtgttaagtcaggcagactcggaaatcgagtacgcgcttccaaccacagagacggaaggtcactggaaaacgatattctgatgatgttcggaggttcaataagaaagacgggacttcaaccttctatgtacaaattaattcaaatgcactgtactctcgcgagactgtacaacaatctataaataaaacaataactctcttatgaaaagacaaaaactcaactccaactaccaggaacaagtaggagttcaaaatagaaacaacgctgaaaagattatgacgcgttcgaggggtctgtccagacccgttcggctcgataacatcgctccttcggcagcattgttcgactcgctcgacaaattcgaaatgatattgttcacgagaagtatccccgtgttagagctcggggatgaaggaagcgatcccataatattaacaggctctcagtttcgttattcacgtgggataaacccgttaattaacgaagctttgacatctagtcagaccaatatcatctcttatctcggactagcttcgggtagatggtcgcaccccctcacagacaggaagacagcaaatagtatagataaatttgtctggccttccgccgtcagtcaatcgcatacctcatccagggccatagggtctattggatttagggatatgcatgggacatcagtgctcgggttacgacgtagtgacgtaaataccattcaagtgaacgattcgccgtcttcgatacccggggtcaaggacggtatcgatttgggcgacgcaaagatcctggcgttaccagcctgggatgtaacagtcggttcactatcactattcgcttcgctttgcttaaaattcagttcgatgctacgtgactcggaaagatcagcgaagtcatcgatcatgagttgtatcataagcgctaacgagtcgggattcgatatcatggacatattgacgctgatcgatagagagagcggcttcgatcctagcgcacacaatattcagttggataagaacggcaatccctccaacgcttgcggcctatttcagatgagattaggagccgtgaatgactgtatcgctaagagaagggcgtttttacgagaaaggggggtaactgagcagaatatgcggcagcttggagctccgctagctgccgataatcatttattcttgatagatatgagtatagatattcagttcgctttcttcgcagcgtacgccgacatcatgtccggaccaataggaaagtactctggttcttttccaatgtcaacacacatcggatggattctacctgccggtccgtcgtcaatagacgtccccggtgacctgaacttagcgttcggacactattattatctacagcagtacatgagtaacgctatttacggattgcagtacgcttatataagttctgatgagtataagtccagtttcgggaatgacaaagcaggacaagcggcgcagacggcgtcaacgtcgccagtatttctgaattatcttccctcttccacaggagtgagagtgataaaaaagatgacgaaagagatgatgtcttcgttcaactctcttagagtgtccgattcagccagcgaagcttacatgcgcacttctggttatgatagaggttcgggttcagtagaggacgagaagatggcacgtgaaagactgaggatgtatggtgacatcgtcaacactcgattcgacaactctaagatgcccgtcgtttccaagtgtcctctaactgtcatgggattccaattacatagagggtataagaaaaacttcgattatctatatgaaatgataaaagcaaacgaagaaatgtactcttctatagaaatctcgcagaccgaggtggtgacacgggggtccaatgtttatacgacccaggagatgagggaatcaggagtgttagggtatgatattaatcccttcttcgcataaaacatatcgtctcaggacgacacagattaaactcgattgtcatccgcagtttaattcaagataccatcacgtgtgatgcgtggtgttattaaccgatcagtgatcggtccccttaggaataagggagctc

SEQ ID NO: 37 - DNA, 1680 bp, Unknown
  derived from dsRNAs of unknown virus
ggtttaaatagaaggagataaagaaattcctatggatgcttttcttttaaaagataaaaataatctcaagatgtattcttcagaccctgttttgacgcctcttttaaaccattttatagtaattaaaatcctataatcttagttaagttaaatattaatatgaaatacttctattcacaagatagtttgcagagctatttagataacataaattctagtcttccattttatgctcgttttgatacagaaaaggcagctaaagtcagctggatgaactcgaagaaaagtgcttcatttattgtggaatctatatttactgaactttttggtaacagaaaggaagtagatcaattgattcatactgctggtgatccaaaaaaagtaagcatatctaataggaatgagacaataaagatccttacttctagcgcttctttgaacctagataggacattagtaattagagtaataggacaattgtccgactgtttaagattaaccggtaagcagtataaatctgtaagtcctactgaagcttttgattcactacctcaagcaacaagttctagttttccagactttcgtaggccaaagagtgtagtaaagacgaaaactctcaagttagttcacagtattgttagatctggcgattttatatttaaagattttccaattagcatcaactggagaactcaaatctcatcatctggaaaattaaaatacagacaattttatccatttccattggttgtggccataattgaaaagatgctcttcatgggattgttcaagcattttgaaacttgtaagtctactccttactgttttgcaaacacatttccagacttaaagtggcgatacggaatgtggcaaaagaagaaattcattgtatctttagactttggatcattcgatcaacggatgataaattgtataatattattggtgttgaagtttttgtgttcgaaatgtatttttacaggcctggaagtaaaactttcaaaacacattatggattaccattgtcaatgttctataatatcaagcaagaatggtgttacttgtatgtttactaaagaaagaggtttaatgagtggttcgtccttgactaatctcattggttctgttgctaatttgttcatgttactatacgtcaataataaatacagattaaatatcgatgtcaaaagcatttccatcttaggtgatgatataatttttgctactgataaatatgttgatattcctgagatttcgaagatttacgaaagcgaatttcaagctgaagttaatttagaaaagtcaaagatctttcatcctggagaaaaagttttcttccttggtcacgaatttgatgacaagggtagatatcttgacaaagaacgtgtcaagttacaattatcaatttctgaaaactatatccctgaggaagttttatctactggcgatagaatattcgggaagttttgttcaatcttatttaaatgttccgacggctcggattactacgatcatcacgcaccgcgcttgttgtcgatcgctagagtagaagagaaagactacttctacggaatctttaatgatagcgggaatcctatgttaaggtataaatttgaagaatacaaaacgaaaggttgggttctgcagtagcaggtgaaaggaagttaatttccttccccc

SEQ ID NO: 38 - DNA, 1031 bp, Unknown
  derived from dsRNAs of unknown virus
ggtataaaatcaaagaagttaacatggcatttgtaattccaccatatttgagtccaagcgatcaaatcgttgatatttatgacaacgatgtaggccgtagattcgctcgtgtaacgaagttttttgctcaagcattagctgatggcattcaggatgtcaccagatcaggattacgaactaagatgcacaacgcttatttgcaatacgccgatacggtaccatctgaatttggaggcgtaaatgacgggggtcgccgtgctgacgtgttaagaagagtgcttcaatcaacatactcacctttggctccagcaaatattggtcagcaagaattagaggcattgggttcaagaagcgcgtccttagcttcagcaccgcagtcagatcacatgcttcagactgttccaatacgtttcttcccaccagcagggcttacctttaatttcgatggcggcagaccgttaatcgttacggcttccaactcctccgctggcgtcttgaacgcagtgttctcattcgacaggccaacttcacttttaatcacatctacagtcccattcatttacggtccaaacggaggtgctccacaaccagcaactaatggcgtaaggctaattaacccaggtacatattacattcagatcgaagctaactcaaacagaaagttcacaattacagctgtaacaccaagagtagtagatgcaacatcagactttgaattagctagtcgcggatacgaacgcgctaaggcatctaagctattattaggaccaatgtacgctagtttagatgaattcattgtaaatcaaacgttcaatcgtccacagacagcacgaacatgcgcattcattgtaactttgttcgaagcatatgagttaacgcacaagtcattgtctattaacgtaaataataactaatatcaaataggaattacagttccatgtagtattcacgtcaagagggtagatgccttcggcttatcccaagagtcgattgcctcgagatttgaatcaatttccaagatataaccgacc

SEQ ID NO: 39 - DNA, 1140 bp, Unknown
  derived from dsRNAs of unknown virus
ggtataaaactttcgaggaactaaactataacgtaggaagtaataggttcatagtaataaatttcgaagtctaacaaatattgaagcacaatcaattatggagaatcaagatgttggtggcgcaaagaatgcacttcaggaactatgtgctggtttgggaatgaaagaagcagaaatgccagtttacaaggatataagtgaatcaggtcctccacattgcaaacagttcactgttgaatgtattgtcgcgggaatcagctgtctcggaatagcaagtaataagaaacaggctagtaagttagctgctgctaaagttttcaaggaattggagcatttaaagccaaagactgaacgtgaaaagaagtcagtgatgagcattcttatgtttgataaagctgatagtatagttggagcggttaaaataatatttgatatcagacaaacaaatgaatgctttgttatattggatgatgggataacgcttgaagccgattatgctacagttactgacagatgtttacagttaatgtttgaaagcggcatgactgacctatcagcttgggagcgtataattaattgtattaaagctagcgctaaggagtctgacataatgtgcaattacgatcagggtgacagtatgatattattcaagaagaacgacggcagtattaaattcgaatacactttaccatttcattatgatagtgtcataaaattatgttatggcaatgcttatgagacagaggagaacggacatatgacatattacgttcgatgctctaaagataatggagagttcagttacgatgctttgaatactaacttgtgcgaactaagagatggacaattgggtttaacaaatcaacgccgtattctgtatgtgcatgacaaaatccatgatgacatggatattgacttcaagcagcttcgtaaattgatgtactcaatattcattaaatgtaaatacagttttaaggctatggactcacgcttgaatcaatctctcgaccgagggtgtgagattgagcctacggttattgaatacgcgtaagaccacgcggggatgctgtggatagaggtccggtagtggctgtaatttaataatgtagtaaatggttgcctaatggaatatgaccgacc

SEQ ID NO: 40 - DNA, 2010 bp, Unknown
  derived from dsRNAs of unknown virus
ggtataaaatcaaccttttgacaacatggcaacctttgattatgatgttacaagcacagcagctaatctaactcgtataggattggataggtatgcaccagattcatcctttggttcagccttaaagccaagattagttgcctcgaacgagcgtgagcacgctttagccttacgtttgaataagattgaacataacatacttgaaaatagaaaacaagaacacttagaccgcgatgctttgaaacaagatttcaatgctacagcgtcagtacttgacacagtcattgattttgataatcatacagagcatatgttacataacattgcagcacaagtcaaagctgtcgatcatgagcgtgagaaggagatgacgttaatactaagtgcagtaaacgaaaactcagtagctattgataatattatcaaagacgttcagattttggacaacactcaaagagctgaattaattcttgagcaaataactgacgtcgctaggtcaacagcgaaggctgctgaaattgccgctgatggaataggagttgtaccagtatttggaccttcgattgcaaatggagcgaaagtagtggctaatggcgctgaattagttgctaacaccgcagatgctataaaagcatcaggaattttaagagaattagatactgtatttaaagcagttaatactgtgcatgaaaggccggctaacctagtagctgcgtcggtagaggcaactaatacagcatccgagttggtcggtaaactcaaagtcttaatggacgcagccaaacgcagaaatgatgccggattctccaaattaactaacaaagacaccatacgtatgtcaacatttgaatatcccgaccaacagaatgaatacttcacacatgtagtttacaacttacatccaaccaatggagctttaggaatgcaagttgaagtacgtgaaaacttgattagatatgacttacgcaaacaatatggtatactggacgtcaataagttcggaacgtccgtaatgcagtcgggagcaatagtcggcatacaaggatcaaagacaacagatcaatttccacttaagtctagcattagccattgtttagcattagttcaagcactctctgaattaagcggtcaaatggatggcgttagcatagctagttatctagaacaatacttcgtactcaatctacttccagacaagcgaccaatcgttaatttgatgaataagaaattacatgacttacaattctcaccagctggtgtgaattggcacttatatgagacagagcttatagctagtatggcagcagctaaaccgatatacagagccgaagtcgaagctaagttccccggtgctggcatgaagttagtgcctgacaagtttgcatcattagaagcaactccacatttgattgatcttgacactcaacataggatcgctgattatggcatttatgaatatatggtgggaccattcactcattctggtacatacagagtaaatgtaatagttgaccaacttggatataatgtttggtacatgcaggtaatgggtgttaatggtcaagtggtgtctgctaacgccaccgatggtgctccactgacaacggctctatctttcagtgtgtcatcacgtggattcatcgataatgaacaagggtgtgataggaagatgattagaatatattcgaaaggatgtaaaaacgttagaatttctgcaggttggggaccaacgccagcaaaagctagaatatccccgaagactttggaagagcatgtaagcaatccaatggattactcagtctttaaacgtcaccttgacccaacaagaaccatcacatctggcaacagattatggacggattacacaattcctggtaactggaataccctaacttagtgaatcatagcaacatataagtttagtttttatcataattaagggaccaaaagtgtaagtgacttgataaaccacttgcatgagtatgtcattaacgagatttaaaaactgac

SEQ ID NO: 41 - DNA, 3100 bp, Unknown
  derived from dsRNAs of unknown virus
ggtataaaatagttagagatgaacgggaaatacgtacgacaaggcagaactaataataatcaattgaataagaagcagagacaagcaaagaatgttgaacaaaagcaatccgacccttcgatggatgagtcaaattcgactccagaacaaaggaatgctgctaacgaaagtggaatgcaacatcaggctggtaaatcttacactgggcaaatggctaaattgaatgctgcatatgatgaggcgattaactcgcgtcgtagccaggatgatgggacgcacgtttatactaagcaaaatgatccagaccttcgaatcatgtacgaagcaagaattactgatcttgaacaacaattaaggacaaggataacacaagtgaacggaccagatggattggaaagaaaaggtgctgttttagacgcacgtccgaattcaaacttcgttgatgtagagaagatggaaacggacatcatggctaagaagatggcatcaatggtcgttactcctctgacctcacgtaatcaaactgaattggttgagaaagctcacgccagcatgtccgacgctatgcgtcatgttatgccaaccaaagagttgcagattgatatgatgcgtggggtttcagctgaacagtatggtcaacaattaagtggaatgcaagaggtattgagggctgaagcgcacgaagttagagcattcacaaggtccactgatgatataattaaaatagatattcaggatactaatcttcacatcgtaacttcaaaacgtggcgcgaagtccgttataattgaagatgttggttcactcgaggttcgtaataacttggatcaagctacgcagttttcgtccttagcgttgcagatgttgaaagattacatgttgactaagccgtgtgttcttgacataggcagtaacgttacaacaagggatctagatgatacctcttatacaaccgacggacttgatttttggttaatagtacaagctataaacgctcagcgtactaatgaccaagtgcagaggttattaccgtcagaaattgcagacatcagagcagaggttacggtatatgatggcgaagagggtactcaaaagactagttgttttgacggtcttatcaagagtcaaatatataagatcgcattagatgagtggagtgaaaacatcattgacttgaggacatatatcaatcttcttcgtccgactataccacgggactataagcttaaagagtatttgggtcttgagtacgatagaggtaaggtctatcataaagaacgtatcaattcactcggcgtattaatcagacttgaggcgcgcaagacatctaggcattttctcggattgttccatcgtgatctgatgaacatgcccgttgaagtgagaagtgtcagcgctattcaagcgagtatcgcaccagacaacaggatatctactaatacatcgagcgtaggtaatcaatttttggctggtttggatagtaccggtaataatagagtgcgtgcaatattgttaatgtgttgcatttttactaaattgcagatagagatcactttcaacacagtacctacgataatcgacatgattggtgcctctttcgttttgttattctttccagaccactccatttctgatgacttgtttaagtcgatactaagtgtcatggcttccttcctgcaagctaggccggttgactggtatcgtaatcatacgatagctgacttacaacaagaattgattacgatacaatggccattttacaacaggtatacaccggctagattagatattgaaggatcgcctgtgttctcaaacggtgaggttggaagttatgatattccatttaatgctaacattgatggcatacatgtctttccacggatgatgactgcaatatcagagatggcttcaaggcgctggcgcactaacaatgcgaccttagggacattattaagttcagtacacaactttgtcactactatcattggtaatgtagcttattcacacgttggagcagttagcagaatcagaggaatgataccaaatgaattagctgaggcgttaaattatactgacggtagtcatgaaatgacagcggcccaagtgtgttcgtacatttgttctttgggtgatataactatcactccggagtatagtgacagacttgacgccgttgcagaggagaggattggcgattacacatcattagcaatagacattaacagatcaatcgcccttactagatcattaattcaacacactaggccaaataacacacgcagaatgaactacacggataatatagtccgattcctgaaggaagcttggaaagatgacgctccagtgataagtccaacacttgatgcattactatcgattgcttcagccaatggaaaagagggatataaaacattcctcattgctttatgtaacgatgcgacaataccaccaccagatgagccaattttaaagattgttgacagagttagagaactgttgatgagtaacaagtcagcatttggtgtcactgatgagatatgtatatatcctccagagttagaagtaataccagacgctcgtttcgcgaatatatttagaaattgtccattcgttgcagcgatgccagaaagatttgaacgtatacattacagagacttcatgttacgtgatgatgccgatagcttgatagttaagggggtaataatacatggtgctccatttaactttaaatatacgatttcacctgaaaatataaactcaaggttgaactcagatgtattaacgtttactcaagctggagtaacgattggaacgatcgattggacgttaggcttctatgatggcccagatagatcacaggatatagataggctaacaggcagaggctataaagtggcaataaagactccagtcaatataaaaccattgtcagaatataatgattataaagtgcaatacacaagtgcaagtagtcaaaatatttacatcaaagagcatacatttgtctatagtcgtgcgtagaagggtgtatataccgttttcgttcgggcaactctagtcatgtgtgtagtgacgcatggcctcgtctatgaatcctgac

SEQ ID NO: 42 - DNA, 1622 bp, Unknown
  derived from dsRNAs of unknown virus
ggtataaaaatttaagatcctgtttgaccgagacttaatcgcaagtagaagtgctgctcatttctgaacaaaaatgaatttcaattacaatatcgttcccataatgcagatacaacctatgcatttgagtctggacagcgactcagcattcagtgagaatacaagtgactcttcttcaatggtaagtgaagctggagcttattacccgaacgctggtgttcatcaaagttattacaacgtgatgccattgatggtaccagttgtcgcaccgcaaccaacaaccgaatgtgtaaactatgattcaggtttgcaagctaagaatctggattatcgtcgtgaaatcatcgatttacgagataagttagctaaggctgaaaatcgcattatttatttagagcaacaagtggccatgatgtcatcactcgagcgtgccgtaacaactgagaatgtcataaaagatttagatcaaaagctggctcatgcagctcgctactattcattaaatccaactaatggttcaactcttccaactaacgatccatgcttgttagcgcgtattgatgctctgttgcgtcataaggaaagtcgtcatttcatctcaaattgcagacgactgattgaaggttattactcaaattctgttgaaaatgctcaagttaagacgactgagttaatgaagtatctgtgtgaacatgattatcatcaatttttgagtgcgtactattccaagatgtatgataactgggacaagagtactgctgttaaatttatggtgcacttacacatgtttgatcataacaaaccgctggacattagtagcgtcgtaaacgtgactcgcgaaaagtataattatgacggggtttcagttgtaaacacactaaagatggacgctgctcaggaggtaaccggacatgattatatttatggaagacatgaccttgagggttatccacttgtagccctacatgaatattcgcatattgatcccgaattaactggacgtgacttagccaaatatcacgttggaacagcttgcagaatgaacgaatgtagtataattgaggtaatccacgaaggtaaatcatatatgttcaagcctttcaaatgttacgactcatacgcaataatgcccttgttgcctggtgaacgtaacaatcgtgttgaagcaattttgcatcataacggacaagtatacgtaactttggtacgtacttttgacgtggattatagtgacatgcttatcgagggtaacatcagtccgcagatatcaaacttggctttgaattaccgtgtgaacaagtttaatgtgttctttagtaatgatggattgtgtgctgacatcgcttgcatgccatctaaaggtcagaaagttgattgttgtaagcatgctttccaaaagaatggtgcacagcaaagaagacacaaacaaccagacgtacaatggaataaatgttctaaagttggtaagttgctgagacagaaaggagataaaaacgtagataataggttgcaaagaccaatggctcatagtgattggaattaaggcgtaatcatcaaatacttgacaatttcgaaagcggtttaacatatggtttagggtgaaggaagaaaagaaacagacc

SEQ ID NO: 43 - DNA, 2339 bp, Unknown
  derived from dsRNAs of unknown virus
ggtataaaaatgagcaagttgttattacggtaatacaacaagttgctgaatttaatagacataatggagagttttcgagatgcaacgtcgttgtcgaagcagtttttggatgaagttaaaacgttaaatttcaaaatgcgcataagtaattcagacaaggaattcaaacattacccaaaggatgaggacttattttattatagtcttggtgacagttaccaattaggtaagctgggtagaataatggatgttgctaaaatacatgttgacaggttcaaagccatcgggtttgttcttgatagtgagaagtcatcaggttcaaagactagtatgatgcgtcaaaagtatatatctggcgttgacaacgtcattggcgttgaacctaatggattagaaaaaatcagtcaacttcgtaagcttaaaacttatgatacttatgattacattacaaccgtcaacgtaattgaggactttgtgacacattgtagtaataggtggaatttgacctatgttgatgaacttctgaaaattcagtatagcctggtttccagttacgtaagtgatcacagtctgatgtttgaacggttaaactacgaagtggaggatgatgtcgtaacggtgcagcaggattatatcaccaaactattcagtggtcgacgtcactataagttggttgaaaatacactaagcaattatggaccacaagtgatggcacctaagataggttgggcgccagagaacggacgagtgaagaatgaatatgctacaaaaggattactatattgtcatgacttcttcgtttcaataggtgattcaccaggaaatcattatctaaactattcaaaggtaattgacaaggatcaggctatagcatatgatccacggccaattgcatttgaaagtatagtagattacagacaacagtattttcaaacaagtgatatagatcatatagtcaaaatagcaaatgatttacaattatcggggaaaacaatgcttataagaatagacatacgtagtgataaaccaatagattttaggcgtgaatatgatgccaggtgggaggatatggttcatgctgataatttactcacagcagagattataaataacatgcctgaaaatgttaccatagttgcgaaattaagaccaagctttagcaagagtaatgtagctccacacattaacaggccgttcagaattcagcctcaaccattcgccacaataactacctcagaatttaccttattcgtaccttcgaaacatctgaataaaggaaagctatggctcaattatagttatgaagatcttattaatatgcaattccaggtgtgtgcattgaaacggacatgtggtaagttgtataatatgtatctttcagatatgtgcctgaatatgggcgttattatagagaagaaggaattagttgattctaccttagcactatacagtctgtcaaatgcaacgaaccgcatacctgacttctctttaataaataattacatagttacatatccatatggacgggttggagaaaagttattacagacagtttcacacaatagagattattttgataatattgtcgatttacagttcgaatgttcggatgacgcaccattggtgattccagtttatagtttaccattcagagttaagactacggtacaggatatgttgactgtgattattacggataatgaattaataagctattcacagcctagtaatcaaatgtccactcaagttgtgaaattagtctcctttatattaaagggtcttatgaataatagaggtattaactatactgacatggatagaagtattagacgtgacgtacttaagcgtttcgtcgaaacgtataatcttgaggctaatatcatagaagagcacatatattttaacggggttaaaatgagtataagcggtcatatgcagtacatactgatcggttcagtgtttggcttaccttatggaatcaaaagatacattaaggaaatagaacgaaatatcattgcaccaggtagttcatatgaacgtaaactggggggtcgcgtttggcacggatattatagtcatttcttggcagttgaaagcgctatgctacttctaagcagtactcaattgctaacaattgaaacatacgacgctataaacaggagctttaattggataagagaacagctaacaaaattggctataaagtacgaggtgtaccaaatagttgatgaaaggagcagaatttagtaacagttgtagaactacaataacatacggtgttgctattatggggccaagttagatgcctcattagacacccttccatttaaacaatgacc

SEQ ID NO: 44 - DNA, 3740 bp, Unknown
  derived from dsRNAs of unknown virus
ggtataaaaatgatctatgaatttgggaagttagatgagatattgaacagtgaattaaagaaggattacaaatcattacaacaatgggttgaacatcaaaggaatgagttgtctagactgcatggtcatcctcgaggtatgattatcattaacgatgatgagcatgccgaattaaaacattatgcttcagacgtttacaaaagaaacgataaaaacgaactggtgtacctaggcttactgctaaataagcaattcaagcctgaacctaacatgtcaatattatctgacgaaagactgagaagattatgtgaatatgatgttggttggtttcggctggccgaacgtattcaggagagacttaacaatggcttggtaattaagatggccaagccactgctttacgaccataagttcaaatacaacataaaacatccaacactggagaataattatctaggttatgatgtgataaaagaatgttcgactgaactattgatgcccgatgatgaaggtattgataatccagctgtattgagaggttggctattagagagtataccaggcttgactacgttaccaagtggagtggagtttgacatacgaaagtcttgtgtcaaaagaattaacgatgaggcaccgatgtacccatatactaatttgttcgaatatgcagctaggagaattgatttaaatgatccgatggtccaactgtggttggagcactttataggcgctgaagacttcttctctttcaatggaagaatgatatcatgtgataaaagtctcttggcacacaagaaattcgaaatgatggtaacctacctgaggactggtcccaagtttaatttagaactagacggtattgcatgtctaaaggaagcattcgttatgattttacctgaccccacttacaattcttataagtgtcgtggtgcatttggtgatttgaatcaacacgtgtttgctaagacatccagtggtgcaccgcctatatctattaacaatataagcagcaccaattttaaattagagcatgatacacacaaacccatgatcagtagttcgctgaatgtgatcgatgaagagtcagtagttgagtcttataataaactaaaacaatttggattgcatttgaatgcgaaactgttattggaatcgcaatattatcaagttaacaaggcaaacatgaagctaggcaaggtaaacaggattgtgctctcatattgtggttatactggcacgcacgccgcctcagcaatagtttcacagttcacagggacgagagataaaggaccttctatctctaaggagttttatgacgctatcgttcaaaatacgtataattacatggatgatggtcttgagcggggtagttttgctacgcctcaaagtagacttgacgtgttatttaaaggtgggacttcatcagctagcagcacatttgaacataagagtgttaatgctttcattaagtataacacaccctttctcacacataaagctctcgaaccaggcaaagtgttacagaaaaaagacggaacgttccaggtaattacgaagatttcggcgaagctacgcacgaagaacgccaatataataactaatcctgccaactttacattatacagttcttcagatttggagcgcaagattaaagctggctccaggttagtaagaggaacgagagataagcgtataataacacctacttacggctcaatttactttaccatgttgttgaccatactgctagcggtaagaatgctatctatgcgtaggaagaacagaccggctctaacaactgaagggcgcgttgggacaacttatgtaggtgcattgccgcacgaagtcatgttgcctatgttagccgtaacaagtaatgaccctagttacttcatcttagctgttgattttggccaatttgattctagtcaacatggtgacatttcgaaagcacatgctgagggagtaagaatgttcgcaagtaaatacacacctgacaggttaaccgacgatcacgatacagtcgacttattaaaagtgtcgcagcataaattattcatgatacttgcagatgcttatgaaaaaccaatgctgtacgaaggacaaggtatagttgctgaagcggcaggggttaaatctggtgaattaagtactcagctgcgtaataccataacaaacatggctcacagtgaattagtgttgacaagatataatgctaacgctaagcggcacattaggatggtgcatgaaaacatagtgggtgatgacaagtacggcgtatttaggatggttgataaacagccaatagatgaggagtcagccagacggatagtcgaagtcgctagagacatagccgaggagaatcacatggtattatcaacaaaacgtactgttataggtaacaaagtcggtgaacacattaagatatgggtagctagaggttacctgactcaagatgttttcttagattcgttcgtctctgagaagaattctttccgggaaatgtcttatttagataggatgacaactctatatgatatatttatgacaatgctgacacgtttcgccgatgtcacccatctgatgcctttgtttatggaagatctgatatcacttgaaggtgttaggtcgggtgacttgcatttcataccaactatagcttgcatttcagcaataggtggtccggagatggtaatgagtgcacctgagatacgtgggatggctagatatatgcataaatttgatgttgccgacaactttaagacaatcaatgatttagtagttacattacgtgaaaagggtggttcagagggatttaaaaggcaaattctgagtgaaataggttcagatagtggtctggtagataagacatggattgagcattttaaacgcaaacgcgatagaccaatgaacatattcactacaagtcagaatgatcctacaatacttaaattaacgcctgaatacgtcgaggaaagactaactaagactgttgttgacacgctggacgagccagtctcgaagtacatgaacaataatgtcgttatgagacgactatttaccagtgaattcaaagggcagttacgtaaagctgacgaacctaagtaccaaggagtattctacttattaagtgatactaagcgtggtataacctcaccgtaccttggagcggatgcaggtgtgcaacgtgtacatgaaatcataggattagcggataggaacgctaatatgactgaacccacggcgcaattagatgccctattgcgacgtaatccgggctcgcatccagcatacttaactggtcaagacatatttaatgcactgagtagatacgaaattggcagttggaagtttgcactcgaaacattggatttcgaccccagcgttgcggagcaagtaataagtttggtatcacagacgatgcacaggttcttggctgataaagatgttaacatgacttccatttttgataatacatcgcgaacttacgatgtatcggacgaaatgatgcgtctaaaagttaatataactgaagctgatatgctgaacgtaaacttacgtaaaggcatgtcttttgaaggtatgaaacacgtgttgtatatggccaggaaaggctatgcagttaaagcaactatgacaccccatagtataaataacgttactataattgacaagtaacttattctctgttagttcaaacactcatctgattattcattcgtttttactaactgacc

SEQ ID NO: 45 - DNA, 4777 bp, Unknown
  derived from dsRNAs of unknown virus
gaataacttataagatacaatgtcgaatttcaatcaacaagcagtccataacttgagaaatcgatatgacacgttaaggaaatatgtagaagacggtatcaaagcagtccgcccatctggtgcaagtagcttcgttgacatgaatgttgacagcacttcccagtgggtcatgatgcaatcgactatcgctaagtttctgcagattacaatacctgacgaagattataaggaggttgagtctatgcttacagattggagtgtagctgacaggtcagattcaaacagtgaccccaccagttcagactattttccaacaatcatacgtgcacacggaaaggagaacttcgatccaatattcaaaaagcgtgcggcagtatttaccagatatggcatggacgcgttacttatggagggtcagagatctaacggtgagcgtggtgtagcgaaggatgattataaaaagatcgcattcgttagcagcgttacttcaagcccagtcgttctacagccacataatggcggtgagaaagcggatgatatacagtatccagttctagggagtgatcgtggcatgttgagcagagatgataaaatcaggctagccctagagggtaagccatattgggtggatggtacaagcccatctgatttcgacgaatcagagacgagtaaggtgaaagaccatatgtcagtccatgccatcaagggtgtgttcagaggtaaagagttcgataacctagaggagcacaagaaagcaggaactttcgttagcctaataactaacaagaaaggcgaggatttcttgatcttaaagcatgataagaccacgctatcccatgcgctcgaaaccttcaaggacggcaaagaccttaacaaagcgaagccagaagtcaagaattcagagcgagacccaacacgtggctacgttggcatcaatggtgtcgcgttgaagcttactgagcaaaatccacttgagactgcctcaactcaggatcccacgtgcggtgtatcgtatactgagtcgtggcttagtaggtggcccgaatgccgcagatacactccattcactctagcctcaacatatctaacatgggtcgaagtcctctctttgcaatatggtgataattgggctgagtggaagcgaaatggaggtatgtgcttacttattggagtgtgctacctcgctgctgagtggacagcgaggatggctccgcttaatacgttcaccaaatcacagttctcaatgaaacgcatgattgaagggtggtcaaaaggcaagcccccatcgggtgtgcctcagtggatggcgagatggcgtagtcacaaatcatacacgtatgtcactgcaaacgacattggctacgatctcccagacgataaagacataatggagtggtccagagaggtgttgtcaaaagaaatcggtggcgtaacaccagtagccacacccatgccatttatcgaaaaggggtctggcgggtacccgttacaggagggtgctctaacaacgagtggcccattgagaatgtttctatgtctgacattagcgatagaaacatgtgggtcacaacacctatctagcttcaacgactactacattggctgccttaagtaccttggtcgcaaccctgggcgcataggtcggaagcttggaaaagcaactgtgaacatggcgcgtttactagggtgtgatgttacgctacatgtacccactctagctccagtccaaggtgatgactacttctgccaggatacaaaccgacgtcgaattcaggacaagtatgcattatctcttttaatgcataagtttaaaatcaccggtgatactttcgtggactttgaagggtgcaaaatgaaagtggcgaaggccatatcagcaatggacgaaatcgctgatactgcgggtccacctctactgaagatctttgaagaatttggctcatacccaaattgtcatgacagatatggaattaacaactttaacaattccatgctcgatgccctgacacatctccaacattctggatcagttgaagggtatgtgcgttcatgcatagggtcgttacctgtagccggttacatgtcaatggcgcagcgtgtggtcatggaaggaatcaactccgattcccccaacgaggctgatcagcatgagcgcgcgatttgggagccaatcattgaccgtatgctgtcaccaagcgtgcctacaatgtttaaacagcttcatagcctatcaaatgctaagtcaagtggccaagataaaatcaaatttaaaattgatgcaaaatacgccgtggacggtgcttctaaccgagagcataagaacattgaaggtttcgtttcaaatcggaaagacgcaatggctataactggtagcttactcatcaatgacgaatacatgcatttgaagtcgtcatctctcactaccttcactagccctggaggtttgcctacaccaagggtaacgcaggctttggttacggggcttcgatccacacctgcacgtattctgaggtatatatataacttacctattcctaatcaggtgttgttatattcactgtatgcagcatgtttagactacatgaaagcaagcgtgactgatcctatatatggatattcacttacccaaaaggaaggtgtgcctgtatacgatgaggctcgcgagatacgcatgtctattgccatggcgagtgatgaatctctagtatctctagccatcgatgctagcaagctagatcagcacataggaaagagacacaggcgtgttctaattgagacgcttcgcagtcggttagttgactctgaggatgcaaccgtcattgaaaagcttggtgattcctacattgaccttctctgtgatatgctagaggagtgggggaattcatactataagatggtagtgccccagtcaccaacacaaatccttcatgtagacactcagccgtcaggagcactaacaactgcagtggacaatacagtcacgactatgggaatggtacacatgatcgaggccaaatccaacgtcaaacctatcaaagttgaggtctggggagatgatttatacttcctttatcatcatgatagtagcagatcatttccagaattcgtggaaggaatagacagcctaggacaggaggcaggccaggtgttgagcacggcagcggactcaacaaccggcaggcacatccatttcctgcagaagcttttcattggcggccaagtaatcaagcgtcgtatggcatatgatcatgagaacgaggtgatgggccatagaacaccaggtgaaataggtgaattcttagacaaggctcgcgagctatcatcacgtggtgggaactctaagcttctaaatatgttacagctcgtaaccctggttaacggcggaagaactacgttatatggcaggcaggctaacatttcttttgatacaatggcggcacctggtggaaccgttaaccgtatactttccggattctctggccccaattcaaaactctaccttgagcttaacaagatgaccttgttcggagatagggatgttgaggtaaacagcagagtaaggtatgaggaggcgcgatccattggaaagcgaatgctagaagatgcaaacgatcctgggcttggaccagcacccatcgaatcagttcagcctggtaacgcaagagtaacagtgggtggtgtagagaaagactataaccttgcggatttgcaggaaaagtcaacggcctcactattggattaccaacgcttacttcctgaagcacaaagaacgcgaatatatgaaaaactactctcccttaccaatctgcatgaatctgagcttgagtcctattcctacgcaaactccatcgtcaatagctcatatagagcagttggcgatgttgcggtaacgaaacacttagcctccaagttccgtgagcaagcccttttaaagtcaggccttatagggaagacgctcacagaagtccctaccccagtgacagagccagcatcctcacacacaggaatcagaatcggtgacaaaacggtggtatatggctttgattcaaactgggccataatgctaccagacaccccaggcgacgagttcctgttatgcgagtatgatatcatgtctaatgcatggcaagaacatgaaagatataagcaaaactggcatccatactatggctacccagaaaacagaaggcaaatgctttcattactaggaataacggccgagtccagaatacagctcggtataaagacttttattaaacgatttagcccagctcacatgcgtaaagatcttacatctgaaaatgtaatggacgcgttgtctagggtggacacgtccagatatgcacatgcacggaatgacctagcgcgtctgatgggttttacagctagcgaggcagactcactaaatacccatctcgcctacgctggcctatatcgtgatattaatacagcagacgactatgcctcaacacccgatgaaatcaaatcctgctcttcacaagtcgcaattgatatattggaaaagacgtcttttggagcttgggaaagcattcgaatgactcaggaattaaagaatgtcatactttatcactatgtatgccttctatctgatgaagcgtgcgtagcctgttcagagacagatagaactgaagataactcttatcgcgtgattgcgagaggtgatgcgcgtctcctccgcacacgaatgattagagtaccaacagttaccgtaaaactacatgtaaataattaacgatatcttataggcgaaaacgtc

SEQ ID NO: 46 - DNA, 4227 bp, Unknown
  derived from dsRNAs of unknown virus
gaatatttttagctatataatgaggaacataattgagttacaagatgagagagagagaaatatcagaaatagattgcatacaatcaaggcgttagtagaaggagcgcaggaaaatgtgcgcccaaccagtaaacaggcgatggttgacgtcggaacgtctcagttcgatatgatgtcaaaagtagcagggtatttcgtgaaagtaatcaaggataatcctgccgatggagctagggcgatggccatgattgaggagtggagtaagcaggacagagctgctgagaatcaaaacgtaacgaagaacgatttcttcccatgcgtgattcgttcggataaggaaagcgacttcaacctttcgcaacccccggcggtgctaacgcaacatggcatggacaaaatgctacgtgcaggattgactgatgggattggaatatcgaaggatgacttcgacacagcctttgtgcataacatatccaatggtggtgtgaccataaaggagaagggtgaatcatgcatcataaataaggtagaactcaagctgacgccagttgaggctaggtctacagagaagaagcctcctatagatagtgatgtatcatacactgaatcttgggttaacagatggggtgaagctagaagatatacccccttcacgctaagctcatcttatgctacctgggtcgatctatacgaacgcatgcacctggagtgggatgaagcgaaagagcgtggtggattttgtttattggtgggaacgctgtacctttgctgtgagtgggcgtgcaggacaggttcaccactgaagtctacagctaaatctgatgatgggttttgcgttagtattatggaatcatggattaatggctcaagtgttaagataccacagtggatgcatacatgggggaaaccgatggcatacacttctaccacgctcgaagacgttggctatgaaccaattaagacgaaaggacttcttgaatggtcgagaggtgagctttcgaaacctatcggcggtgtgatacctgaggagactcgaatgccattcgttgagcgttcggagggtggattcccgctgcaagatgcagcgcttactaccatgggcccattacgcttcttcctatgcttcagtttagcgctggaggtaacaggatcatcgcatcttgatgacttcagttcaggcgtcattggattcagaacctatcttgaaggtgcactcctatacttaggcaagcatcctggtcaagtcggtaggaaaatggacaaagttgtggtccaaatgatgcgcttattatccgctgacctgtctatgaatgttccaacggaacagcttgtgcgacaggaattcgatgatcatcccttcgaaggaaatgtaatgcgcaacgtccgaatgtatgataagtattcgctagcgatacttgcacacaatcacaacgtagctccaaacaagctcgagatagccaaagctattgcttcaaaaatccctgagctggaagatggtcttatgcgtatattcatggaattcagtggtagtgatgaagcgattaataagtataacgtatctatgtacaatacaaaggtattagacgtgattacacatcttacccaccctggtaacatggaaggatatagtagatcatgccatggatcgctacccgttaagggttacaaatctgctactcagagagtggtgttggaaggcattaactcgagcgcaccccgattggttgataagtatgaagatgagctgtttagggatatatttgatggctttatccctccgaatgcatcggacatgtttgagcatatgtggtctctgtcgaattcgcgttcaggtggtgctgaccgcattggattcaaagtatcgccccaaacaatccttgactcggatcttgccgggcaatttgaggaggggtttatctcgaacaggaaagatgtcatgcattttactgccgcatttataatgaacgttcagtctatgttgacgcgcgctactcctgaaatgccctttcccttaggtttgcggtcggtcgcagctcgtgtactacgatacatttataaccttccaataactcagcagattatcatgcgccctatatataagcatatcaagagtttcatggcgcactcggaagatggatacgccattgaacagaaaattggtgtggctgttgctgatatgtcgaacgagctgaacagttcaatccaattagcacatgatcccaacttggtgtgtttagctcatgatgccagcgcgctggatcagcacatcggcccgcgtcatagagaggtatggaggaaggttatggcagatatgttggccgaattttctaatgatagcctggaaggtatcctaggttctgacgtcaagtactcagagcttgtcgataacgtactatcatcatgggatgatgcgttcttcgagttctcagtgccgcaagcgccatcgcaatttctgcatgtagacactcagccatcaggtgccataacaaccggttctgataacactattacgaccatggctatgttaaacatgattgagaaggaaactggtgatatccccatctcgaagcaagtttggggtgatgattgctacttcatgatgcagatgccggaaactcacgatataattgagaaagtcaagcaacacgaagatttagcgactgaagctggacaagtgcttggtactataaaagattcaacaagtggtagggttgtgcacttcctgcagaagttgtatgttggtggtcaagtcgtgtcgcgccgaatggcctatgatcatgagaatgcccaaaatcatgaacgcttgccgggaatgataggcgagtatctagataaagccagggacatgtcaatgcgcggcggtaacttggtgttactaaacatgctccagttgatgacaattattaatggatcgcgatcaaccgtatttgggaggcaagctgtgacgtcttttgaaagcatggctgcgccaggtggtactacgaatcgtcttatgtttggtttcggacaacctaattctaagttgtatctcgaactgaatttccctaggatctatggcgacgtatctaatatgacagtagactctaaagcagtgctggacaccccgagagagataggtaaacgggtggtagaagagttatccatggaagacaagaaagtacgaatgcagctaggtggcatggaagtcaaacgtcctgacggtgaatcctattcaatgagggaactgcaagaaacggcgtcacagcgactgcttaaaaccgatcgtaggcgtagagcgccattaacagtgtcacagcgtgatgcgttgttggagggtgacgtcatggaccatgattatgaaagagcggtgatacgcggtggtcacgaagctatagggggaattctgcgtgacaaaaggatgaactcgaaattcaaggagaaagcgctaattgataacggcttcatatcacgcagtgctgatagatcattcgtgcccgagatcaaacaagtaccagttagtacgcacactggcatcagggttggcgatgcggttgtgacgtactctttcaacagctcacatatactgctcttaccacgtaatagtgatgagcagttcgagttacagtcagttgctggtgatgaagtctacagatataaacagcattggcacccgttctacagttaccctgataatatcagaatgctgttagctttgaccgggatacacgcagggccggaccggttgaagattaaatcgcatattaataagttctcaccctcgcacttccgcaaagatctaatgcctgaacatgtaatgcatggcattgataggatgaggaagacatctggcaaagttcgagagtacttacgtttcattgggttcacttctacgggcgacaataacgaaatcgacgaaataatgcgtcatattcataaaatgaatttatatcgtgatttatccgttgcggatgagtattcgtcagttttcgacgtcgcaaagtcatgttctacgcaacctattatcgatcttatctctcgcacctcatcctcattccacacacttctatctacaacggattctgaagtgcgtggagtggttctaactcattatatcggtttactatgtgacgaattgaatgtagcgtgcgtgcaacacagatcgagtgggagcgatcgcaatttcattcgtataccgatggtatcgattgacatgacagtctaaaaagtatgtagctaaaatggaacatc

SEQ ID NO: 47 - DNA, 2025 bp, Unknown
  derived from dsRNAs of unknown virus
gaatattgaaatcttactatgttttctcgtactagtgttgttgataatactttattgtatgctaagtcggttgctgaagcggcgatcgcgccgcagcaatcaggcattcgtgggaatctgcctgctccaatgtctgaagacaatgtgcgcatgtattcgcatcccggtgctgggtcagtgaccgtgactgcgtcgacctgcaagtctgctatcgtgatctttgacccagaggcgtctttcagaaacggacaagctaatgtgcaagtcgttgagagagatggcagtaatgccgctatcaaagtcagcactgttaacattggaacggcatccaaggattacatctctgccggtgtaatctcagggtccctgtcggtgacgaacagctctggacgtgatgccgtcgccggtacgcagactcatgctgtgctgtacgccgtgcccaagaacttgactacattatccgctacccagctactcaacgccgtgatcgataagaataaagattcgatgcagggagtgcgaagtgccaatgattctacaacttccgttgcattgactaaccattttggtaccaagacaaacttgatgcgcgagttcgctaccggaaacgttgtccagcacaacagaaacttcggacgtgtatttgatggaggagcaggctctgtgaactgtttcaacagtacctggacccagaccggagatatctctgcagacctgatccgttcggcccctgctaccaatgcattcttcagaactgatctcgctacgggtaatgatagtcctttcacactggcaacctatgaggtttcgcttgatatccaggttaagttcaggaacgagaccgcagccgtagattctgctgctattgtgctacgagcgttcgccgtagacgcagctggcgactctattaagaccgattcctctcgtcaatccctaacctttgggccagattctgatgctactggaggtgatgccttcacagtgagctatcatattcatatctccagtgatgataagcccatcaagaatgtgtatgttggtatgcccgagatcaggggcttgtctggtgctctcagcctaagtaacgaggcaaccgctaaactcaccacttacgagcaatgcagtgatgttgcttctaggcctattcacgtctgtgtgttggatggtctgaatgattctgctactatctcaattagcgcaggattgtccgttgctggtgtaccagattctgataatgctgcgattagtggatccatcgctaaccttgaattgtatgatgacgagatcatctctcagtacttgaagagtgtgtctcgtggcctaaagcatgtgtatacacaagagggtgctgattggctcttccaaactattggctcttggtctgatagccccgagttacagcgcgaggtatacgctatgaagatgaaaagattcatgcgtggagtgaagaaggccggagaaatagcgaagaagatccacaagggaacttctgaggcagctcgtgagctcatgccatacgctgaggcagctgcacctcttctactcgcctctggtaatcccgctgccatggcagcaggaggcgcattgactggtggaatcgagacattcaataaaatggatcaagctggtctgattgaatgaggtgtatgccatttccctgtagtcgatcgcgctggcaattacatagatactctaggacttaagttaaccattaaacccgacatggatataatggattactcaaaggacgtaaaacatctaattaatgagttcaaagtatatcctactataataggtaatgatattgtacatgatgattcctgggaaatggccttcgtaatggcgctattaggacatacaggcacatttagtggtaatatcaaatcaattgaaggtaggtatgtatcctttgggccagtgggtgcgatgcaagaaaaactaaaaagtaataacaaaacaaaaacgtttagagacatagtgggagtgatcattccccagtgataaatctcgatttcatgaaacatc

SEQ ID NO: 48 - DNA, 917 bp, Unknown
  derived from dsRNAs of unknown virus
ggtataaaattctaagcatgttggtatcagatagtgtgcttcgagtctcgaacctgaaagagttcataaatttcatgaaggtgactgaatttgacacaataatttcagccgctggagttggatttagggcgaaggatgggataattagtcgacactcaatatatggcaacgatttctttctatatcagggtacgtacttagacggcgtttcacgtaatgtaatacccaacttagtgggcatgataggttcaatcataacattcctcacaacagggcaggcagtgtattttggctcagttgatgcagctaccagaaatctaacgctatatgacataatagctagaccagaatttaattttaacacaggacagttaaattattacttattaatgcggcagttagatgctgaattaatgacattagaacaaaagagaagactattaatagttatgagattattagcgaataaagatggtaatcttaaacaattggatgatatagtgaaacaaatagccaaactggatagtgcagttattatttgggatccaaacgatgaacgaacgtatcacagggcaaccgatgatttaagattagttatcagtaatggattgtcgaaagagccgcatcagaatttcaggctacagaatagttatttggacgcaatgcacaatagacatttagagaactttgatggtgggttaggactgattaaaacctttcctacaaatcagtatcactctagtaactacctcagcactttacaacggtatggacagccgcctcccgttatatataacaattaattataaagggttcgattttcggagcattagcagactatcgcaacatggttatagtgaagatggctcactacacgtcaacactataatggataagcccaagaatatgaaccgacc

SEQ ID NO: 49 - DNA, 2073 bp, Unknown
  derived from dsRNAs of unknown virus
gaataaaagattcttatattttattacaacataaagttatactaacaacaatgagtgctactccccaaatccaaactgaagaatacatcaagaaattgattaagatcatcaagaacccttacgagaacgcctcgcccggtgatctgcctgctcctgggacatcgaccggtgcagcggtttacagtactgaaggttcccagtccatagcttgcgacgagaacaccacgtctgccattgcggtctacgaccctgaggttactcttcgtagaggtcagcccgctgtacacatctatgaaagaaattcggctcacaagatccttaaggtccagagcatgaacgttggcagaccttcttctgatttcttggctggtggcgtaatttcttcatctcttcagagctccaacacctcgtcggtagacagcattgccggttctcaaagtgcagccgttctatacgcagttcccaaatctttggccaatctaaaatctaccgatctgtctcagatttgcctgaataaggataaagatgtggttcagaacgtttcttcaaagaatgactctacctggactgacagccccaccgatcatgccggtgtgaacactgctcttctccgttctggcgcacgtgcccagatctgtatagtttcgaacattgttaccgctactactgctgccgcacaaggttttgtagtcggtcttggtggtgctttaaccccgactgcggatcccaaggttcaaccgtatgctggtggaactgattcctcacccgctgctcttttctggactggtcgcgattcaaccgttagtccttttaatcttgccacttatgttggtaagttggctctgaacgtgagtttgaagtgcactggcgctaacacgagcggcatcgttttccttgtagctgccttcgacgctgctggagaacagctatccacccaggaggttaagcttgagggtgcggacctagccgataatgacacctttgacagtcacattgacgtaactcttaagtcatctactttccctatttctagtatgggtgtgtggataaagactggtgctgtcgagcgtgctgacaccgtgtcctctgggctagttgaggctgaggaagagacaagtgacatccccgtaagaggagtccacgttgtcatcttcgagggcctaaacgcaaaagcctcccttaactttcatgctgccaacgttttgacgggcgttcctgactccactaacgccttcatctccaattctgccactgatctagttcttgacggtaatattgtcaccaacatgttacaggcttaccgccagaatgcagtcagggcatacactggggcaggaaaggaagcttctggtcagatcattgatgctacccttgctacccctgagatggacgtgaaaatgaacgccttcagttttaaggacattggtcgtgcattcagacgcgctgtcggcgtagctaaggccactaggcgtgatgcatccaacatcgctgccaccattcagcctggactacgtgagggcggcggttatctgagcaccggagttttcggtcctcagggccaggccgtagggtcgggcatgctaacggccgatgctgcgattaacagagcccgtaatatgggtatccttaccgagggccagcgcattgacatgcgctagggaataagccatttcccaactatagccagctatggtgatttgttaatgccagggaaactatatgcaatgtccataacgcgaaagcgaaactatacaggaacatccttcaatccaaggctacttgagattggggaccctataaaggaggctttacgcgatttaaacgttagcaaagttgatactgatgcagacgccgatatccatggcaggtcatgggaaatggcatgtgtaatggcagcgatgggccatactggcgcttacagcggtatagtctggggatacgacaatggcctagtaatcttcgggcccgtaccaggtgtgcacataaagaaaaagttaataaataacctaaaaacagttaaaaatataccttcgatacgtgttccctcacgctagatttgaatcttcgaacgtc

SEQ ID NO: 50 - DNA, 1207 bp, Unknown
  derived from dsRNAs of unknown virus
gggattttttgagtacacagtcgttgatcataatggcactggttaaggataagtttagtcacgtcaaagaaggaacgggtacagtcagatgtattaatggaatacagactctaatatttagactgagtaaagatgactctgttataagtttacctcttcctggatgcaacagagtacgggctatagccgtattggtgaatgcaatggaactgtctttgattgattatgatggcaagtaccaatctgaaatattatccactctcaagcaggtaggtacgtcatcaactttcaagctaggtcggagatacaacccattgtatgttaagagactcagcttcgatgataatcatcaatacactcatagcttgtatgctgtgatagtgaagtgttgtggactattgaggtttgatgatgataaggaatgtcacctgataatggaaagatgcataccattgagtccggctgatatcacaatgcatgctatattatcatttatgaatagactgaaagttatgcatgatgatggagtggttcatgaagatatcatgcctgataacctgatgctatccaaacatggtgatatagtattggttgacccttctgttgtagtaggagctaatgttgtgtatagaagtcagcattacactaacgtaataggtgatgatgtacgacttaagccactaaaggaacgaatggctttggatgttcaacttgctttgcagagcttcatacaaataaggtataatgataatttcagtgatttcgtgtatcacaatggtatgctactggattcacgtcctgatagcatagctagtgatgagtactgctgtacagattggaatcaattcacaagctttcaaagttgtgaagaattcctgacctcaccttttgcagccaaagccagaaacaaattgttggatgacatcaccagacgtctcagtgatacagagagtgatgattatgatgatgatgaagatgaggaagaagtttcttaccacgtaagaaataggtctttcttggtagatgaatcataatgatggaaagagatgacaatcactaagctgtccttgatcacgccagcggcgcgggtgccaggccgcgacgcatgggctagttccagcctataaagatcgactctgggggggtatggcttgctgtgggcattcgtgctccatggtcacctccaggtgcaacttgattacagacc

SEQ ID NO: 51 - DNA, 1952 bp, Unknown
  derived from dsRNAs of unknown virus
gggatttttttgttctagtgcaacatggcggtagttgtgagtccgtttgataatgtctttactacagatgaggcaactgcagtaccaaattatggccttgatccactttattcgccgagctcaggaccctttgctggtaatacctcacccatcaccaatgcctttgcgcgtaacatgcatggatcgctcgctcaagcacgcttggacatcaagcgagcttcacgagatgatgatgcttaccgcaagcaactcgaggttgatttgaatgagatgtcatccttcattaatcatgatcatgataaatcagtagcaagcgaccgtgttctgcatcatctggcagacgctttacatgctgagattgataatgagaatgatttggctgctgatcttacgtcagcggttgtaaaagatgaaagtgccatcaagcagatcattgaggacgttaaagtggtgaacgcagcggagaaggctgatttagttttagagcagatatcttcttatgctactatagccagagatacagctaacttagctgctgatgccgcggagataataccttttggcgcttcagcagcaggtgtcatccgcacaggtgctgacatagctgatgtggtcgctcaaacaacaacgacgattcagcgttctggcattacaaaatcattaggcaatgtgataacgaatttgcacactggggagctttcacctgctgaactgttaacccagtcaatgactgtagctaaggatgttgaaggtttggttaacgagatgaagactattccgatgcgcagggagcgtagaatagatctgacgttcgcgtccgcatctgatcctacatcagttatgcatgatactgagtattactctgtgtatggaatagaaggtgctccaatgtattatgtggtccgtgattctaggtcaccatactataccaagatcaaggttgatggatatggtctgacttatgaggttattcgacgcagtgatggcgtggtcaggttgtctaatggtacagtgagtctgtctggtactaagaagaaaattgctaatagatctgagatgcatagcgtgatggctatttgtaaattatttgggggtttcactggaatatcatacaatgtgaacacagtcagatcagttattgagacattgatcaccttgggtacagtgactcgtgaagctttaactgttgacacatataataactacgtgtcatacaagagtgaatttgatcatgatgatgctgagagagttgaccactcaaatcttgtgcagcagttgagtgataatagagaggcttggaagacagacaacccattaagagtacctctgctcacgcgtgattctagagttaagttcactgatcagctacgttcatccaaactgaatctattgtttgttgaaggtaatgactatagcgtgtatggatgcagttatggtcctatatccaaatctggtactctgagggtagcgtacatggttagtggttgtacaggtgcctcaaaagctattgtgcaaatggctacgcaatccaagaatttcgtatccacggtgcaagatgatagcatgggacagaggtcttttacgatctctaaagtcggtggcctgcatatagcagaaggtgacatgttattcgtgagagtatatgctaagtctgacatgactcccagagtatatatgaaactagtagacaccgatgatgggtttgatgtacctgtcactaacgacaaccataacgcttcagtagagttcaagcgtgattataagaacagattcattgaggtgccagtcaacattaccaacgctacattgtcaacaggtgccatagcttggtctgattatgaaccaccaaattggacatttgtgcctgcatagatggacatcacaacaccgcagcggcagggtctttgacattgctgcctgccgtgtgtgacgacgcattacaaaaacagacc

SEQ ID NO: 52 - DNA, 2723 bp, Unknown
  derived from dsRNAs of unknown virus
gataaattaaagctacagaaagtgtcccactcatactggctgaatgactctgctcaaatcacgcctacactctcttgatgtacctactgcaagatacgttaaacatgaagagctcgaagaacagattcaaattcgtcgaagacgcgggatccttcccatcgtcagtaccggatcgaatgcgaatcagatagtgatgagacatgccttcgttctttcgtatccaggtcaagagatacttaccacctcacccatgcttgctgacttgatcaacaagaccaagaaagtgtctagagctcaagtcggagacatgttacgtgaagtattcatgagagatggtactgtgcagattggatccgagtttcgacaagctgaatataaagttagggaggatatagactgtgaactgtacactatggaagacgattttactattgatgacttgattgatggatatgacattagagtaagatattccatagccgacattccgagtgatacaattagagatgagatagtagaagattttgttcacgtaaagcaggataaaccattaggattggcacgcctcaggaacattactttgaaaggtggtcaagaagcggtattgaatgatttgcgggagcctagcctatttagaatatcaagtagacagatagatgaggttatgattagtaactctaatccatacgatcggcccattcaattgtaccgtggtggacagcttaaattgttgtggagcacacagcctgagatattcgcaactagacctaatcttgtcatatatgtcggaggagcaccaggcgattgggttaatcattactctaaaattaatgcaaaaagcaaatggatatgtattgatcggcaaattcctaagtatccatgtcaacacatcaatgactacgtcacagaggacaacatctctaatatattgtcagtgattgataattcaaatagagtgatggtcatctgggatgtaagaaagttgagaccagctggaatgggtagagatcagtggaatgagattgtgtctggtgagtatgacctagccaaaaccttcttaagtgcatgtatcgctaaatttggaagggtgtactgtcatgtgaagttgaggccagaatatcaaaaacggcagaccagatacatatcaggcacaaagatcaaagtccaggctttcaacaggttagattcacatgagactagatgtgttggatggataactggagttgatgatgatttcattctgactgaaagatacatagacctcattgaccagtcttacaataggaggagagacttaaattattcattagatctacgagtcatctccatgcggttgcaggaggctgtctcaaagaaagtaatggctaatgagtttcttcaagtacctagtgataggatggttgctttgttcagtctgtcgaatgccttgaatatagataataaagaccaaatatttaggaaggtatcacagggagctgttgtcactttggaatatggtggtctagaacgacaaggtcagacttttggaacagtcatcgatggtagagaatatcgtgacttctctgtggatatacttgatgacgttactagacatgattgcacactgcaaccactgtggcatatgtttgcagtctcacagatggactatgttggtgactcattgtatagtgtcgtcctggctactagacccagacatacatatgaacaagaaacgtctgtcactacagagatggtcaaggctgtgtctgctcagttgaaattgaattacttcccacatgaccaagatagagtgtacactgttaggaaagaagtgataaatactcacgctagtaaatatggcatagtaggtattggatggagaggtgactatagagtgattgatgataagttcaaggaaaagagatctgtgtctgggcatttgttgtatgtactgcttggtgcttgcttatatcctatgggagtaagaaagtatgtccaggtggttatcaataattcacaaaacatgtctataggtacggaactgaagaatctgactgaagagcgtaatcgttggcattacattctagactatatacttgctacatatgcggctgagaagctactgtctgagatgatttctggacttaccaatccatggaatgtggatagatgtttcagagccatcaagatagtcagagaacagttagaagcatatctacagtgtccgtctagtgttccagtcatactcattccagctatgggtggcaagtcaactctatcaagtaagtttgattatctacatgacatagacaactggtatgagaagactgggttctttgcaaagagagaagctggaatgaccgaacaggaacaagaggatgcttacaatgatgtactcgattccatcttattggattggaggtctatgagagctagagatgtactactctgtcacactgtgtcacaagctgaacatcttaaagcacgcattcttggaggatttattcctagtaagagattacagcggatcgtgatgcagaaagagaaaccaatagcgttgagggtcatggtatctaagatgaatagaaaggatattgccgaaatctctcactctgtatatgattctttccctcaattggaagaattagtcgttgaagcagcaaagaaggcagtctgtaagagctagagcgttcagtgtagcaggtgggtatggtccttacattctctgtagttgatcaacgatc

SEQ ID NO: 53 - DNA, 1964 bp, Unknown
  derived from dsRNAs of unknown virus
gggattttttgttagtgtgcaacatggcggttgtgataagttcatttgatgctggaataggtgacgaggaaaccacacctttcccaacattcggagttgatccaatctattcgccgagctcaggtatatttgctggtttagcttcgccgattacgaacgcttgtcagaggaatgtgatagggtcactctcccaggcgagggcggaggtcaagcgtcaagccaatgatactgtgaaatatcgcggacaattagaaacagacattgatgccatctctaacttcatcggccacgatcatgagaaagaggtagctaatgatagggtattgcatcatctagcgtatgccttacataatgagattgataatgaaaatgatcttgctgctgatgttacatcgtcaatattaaaggatgaggatgcaattaaacagatcatcgaggacaccaaaattctcagtgttgcggagaaggctgatctagttattgaacagatatctagttacgctacaattgctagagatacagctaacctagtggctgatgcagctgaggtagttccatttggttcttctgtagccggggtcattaggactggcgctgacacggctgacctcgtagctgagacggctaccaccatcaagagatcaggtattactagatctttaagtaaggtgatcaccaacttgcatacaggtgagctctctcctcaagatatattaacgcagtcgatgaccatagctaaggatgtggacagtttggtgcgagaagtcaatctcattcctgcacgtcgcgaaagacgcctggacctcacatttgcagcggctacagacccgacccctgtcattcacgattcggagtactacgcacagtacggcgttgaggatgctgctatgtgttacgttctacgtgacactagatctccttactatacgcgtgtgagagttgacaattatgggtttacatatgaggtaatacgaagacagaatgacggtgtgcgcatgtcaaatggttcagtcatcctatcaggtacgaagaaactaataccaaacaaggctgaaatgcattgcatcatggcattgtgcatgttgtttggtggcctgaagggtctcaactacaacgttcatactgtaaggggtgttcttgagacattggtggcttcaggcatcatcactagagaggctttgaccaatgagatgtttgatacgtacatcatgtacaagagtatgtatgatcatgatgacgcagagagatttgatcacaatgagttagtggctcattacggtgagcgtcgtgaacaatggaaagccaacaaccctgacagacttgaattgatacctaaggattctaggacgaagttcacggaccaaattagatcagcgaacctgaaacttttgttcttggaaggcaatggctactcagtatatgggtgtagatatggctctatctctaaggcaggctctctcaaggtagcgtacgtagttgggggatgcgacgccacgaacaaggctatagtgcagatggcaacacaaaagaagaattttgtctccatcgttagtaatgaggacgttgggacaagaacttttaccatctcgaataacggtggtttgagcctggttgatggtgacatgatcttctttagaatctatgtcaaggatggcatgcttcctaggttatacatgcatcttgagaacacggtagatggttttgaaacaccggttgtgagtgataaccatagtaatcttgttagttatgagcgtccctataaacataggtatattaatgttcctgagttgatttctgcagcctccgttaccacaggggctgtggaatggaccgactatactccaccagactggacaaaggtaccagcagcgccttaatcagcatctgaacttatctggccgcagcggcggggtcttcggacattgctgcccgtcgtgtgcgccgacgcattaacaatacagacc

SEQ ID NO: 54 - DNA, 3037 bp, Unknown
  derived from dsRNAs of unknown virus
gggatttttagtcgtatcactaagtatatgtagtattatgccgtcgcgacgaacaaagcgcaagtcaatagctaataaggagaaagtagataaggatcaggctctcaaagatgacggagcagaagtcaacagtaaaggggggaaaggagcaggagccaccgctagaaaagtcggtaatggaaaggatattaacatcgctgcggacgcctattcagtgcggtttccgtcaaaggagatcgctgtggacatggaaaaggaacctgttccaaaagtaccccctatcgagtcaggagctgagggaccaacagttgaaggactaaggactaacatcgcaactaccaaaggactcgataagttagtgaacaccaaggctgagagcaacgctcaaccagccacatcgggattacaggtgatggttgacgctagttacaaggagaagatacagtcattatcacataatagagcattattagagcaggatgtcattggtcctgaggtattagttaaagcaaattttcagcctctccatcttgcccaattggagaatctggcagatgctgtgattgaggcaacagtttctgaacccaccaccgtcacttttgataagcatgtcacttacagcaggttgccactccctaaccctaatttaaattacattatcagtgaagatcgtgcttcaatcatcataaaggagagtttacctcaaataactgtggacatgagggttgacttggatcttcagatcagggcagtggctacccaattagttgatgagtcactcctgactccatgtgtttgggctccaccaatggaaggggagataccctttgaaacatcaggagttcagatagctagagagggtgctgacattgatgagataattaggttagaaaaggctagaagaagggcagttgggattgggcataacatagtgggtgaagaatacattcgatataagacatctcctcacatcatctcggagcctgatggtaactcaaagacaataaggatagatggattaattaggaatgacatgcacaacaggattattgaacaatggcgccctggaatcatacctgtatttgaattacaggatagtctactggccaaggttcctgctggttacatcttcccgcgtttgactacacagatgcgtaggtggtactacacctatcaggatgaccacacggttagtattggcgctctcttcgatgtccttcccgaggaatgtagtgagtactataggaatgtgtacatgcaaccgctggccggtctcaggatgttggagacaaacgtcctcaacgtagctagatcttttagtagtaaagcaggagtaaatatgaactcaaccacagcttcttccttgctcgcggcagccttgactgagaaacaggatgtgcttaccatattgcaaacccttatgatgtgctcatctttcaccaactataagattgactttcctgagcccagatcaacaactgtagttgaagcgatctcagcatgtatagtgctattgacattcagcactaacaatatcgatgctgagacgcacagggtgctcttgggtcacatacacagttacgtcattggcagcgttcacagaaggatgcctgtgcaacaaatgattgatgaacttgagaatgctagatggccgatcatatatcctcgtgacccagttgagtttgttgctgaaggaatatctcctatgcttgatgataatagagaggctaccatcaacgccatctttaatttggatccaagcaatgctagggtagaagtggaggatcttgtaaggcaggtgcagcaagttaagtatgctatgtatgatgagacagctagattcaagggcgcactcgctcagtacctatcgcagtactgccaagcaatggctgacgctagtctcagtatgcataggtgggcgattgatttcagactcagtgtgcccactgagcttagagatagattcagaactgataactatccagtgatgataacacctaagaaaatgttgagcttttctgcccagttgagtgaactcatatatgacaacactgtaactcaggatttgactgaattcgcgaatgctcgcaatgatgaattccttgagttggataaggacatccaacaagctctgtgcatcataaagtctgccaatttagtaacagagactatgcataccagtacaactaagaaactcacagccatagaaaggtttgtggataagaacatgccccaggtatcaaaagctctaaagaatattttgacaatggtttcatactctgatgacatcaagaaggggtacaaggctttgatcacattgttggctggattaggaggacctcacctagatgaggagctcaagcgtaacccaatgaacagaataaatgagcagatagtagagaacgtcctggagaacttggaggcttatggagtaaccgagaaggttttgatctgtaggtccgacaaggctgagaggttgcccattggacttttctcaacagacatcaaccatctgctgtacaaatcgcccttccttgtgaccgtgccttctgatatagatggagtaccattgcaacgtctgacctatgctgactgtgtattgcggggcttcaccgttctgatgagcgatggtgcctttatattagagactcgttgcaactttgaatatgacatcatgactgaggactcagctgttaccagccataaccacaccataatcgctgagtctactgggttcagactgatggatttgaagtggaacatcgggatggcaagtatgaatcctgatgagaatagagataatataagcatgatgggaagtaggttgtatgcattcatcatgaaaccacagaatttgataccctgggagcaaatcatgaacttggaagctgtgaccagtcacatgccaaaggagattgtgccttatggcaaggctatgactgctacgttaattgaatgatcacaaggcgtatacacatatacaaggtgagtgcgtgttaagttgtggtgactagcacgtacagattatacaacagac

SEQ ID NO: 55 - DNA, 3732 bp, Unknown
  derived from dsRNAs of unknown virus
gggatttaaagattcatgtgaagatggatatatatgatagtatcaaacgtgatcttaaatttatgcaagatgttgaagtagctttcagggagacgattccgaagacgtattttggcatagatgatgtggaggatttatatgttgatgatgttgacatctctaacgtgcataacaatttcacgttaggtaagcgtaaatgttatcatctgtggaagaaaggagccagaaccgccattcctatatactatggttcgctcgtgacacgtgaaaataatgaatatgtagatagatcttatgtttatgataatctcaatgttatatataaggatgctcctgtgtgggaggaattgcttaatatggtgaatggatggtatgatggtggttggacagtgcatactagttccgctttgccatatgatcctgaatatttcaaatgtttggtacttgatgctgatagatacaaaggtatgcacaagaccatagtcgacgttgattatgatgcgttcaaatggagtatagatgtaggttcagaagccatggatagaccaaatgtcataagagcgtgggacatcaacacaatacccgagatagtggatgacttttcaatgcgtaaacatctcatcggtagatctaagaaggaagcacttttctactttaactttagactcattccatatgtcatacataatatagataaggatgacccgatatggagagaatggttgagctactttttgaatggtgaccacttcaaaccggacaggggtagctatgaaaactatggatcattgcttgggcacaaacgattagagatagtgttgatgttccacaacaggatgcgtctcatgcctatgtctgctgctgggaaggctgcgatggaagaaggggctaagttcctgatgaaagatccagtgtataacacggcattgatgaagacttacaatggagtgatgacacaatatggaatggctcaaccttctgagttttgtaggggatggtcgcctgctggtgtgacgacttcagacaaccctttagtgttaagttctaacgtaagtggggctgatggctataccgtgatagatcatgaagcggttgaggaggccagagcaataggtatgaggtatacacccaaactagttaaactgctgacagagaacatgtccaagaactcaactcccaccaacctaatcgagtcgctaataggtaacgctacgattagtctgactgggtttgccggctctgagcgtgtttcaacagcgcttgaccagtttgagaaggagaactttgaaaggaaagtacctgaagagctgttcacagctataagtgatgtgacttacgagatggtgaggagcagctttcaaccccttgagagatcaatgatggatgaaaggaaaaggttgttgaggttgtacaacgctggcacttcagcttcttcttcagctccaccaggtggtaggtacatcctcaataagaagagaattctatatagcaccttcttatctaaatcactggccgtgaatgaggattatgcgcctatgtcattcattacctctcttaatctaaacaataaaacagctaacatactgactcatcctgagaactattatatgtatgactggaatgctaatcatactagggatataaactcaggttctagagaggttcgtggaggcagagctacccgtataatcacacccgaccctccttctaactacctgttgatgttgcttggcgctcttaacaccgtacgtgatatgggtagtcacaggactggtttctcgaacttgggcatgaatgagatggttggctcaagctacgtcgacgctaacccacacacagcactggcacctcagtgtgttgcaacagccagtcacagatccttatgcagtcaggcgttggattattcaacatgggataggcaacagggtgggcgtatagctgaagctaaagctcacggaatactgagagttgctgatgagctatttcctaatgccagtaccgagttgtataaggtacacaaccttttgaaagcgtccatgcgtgatgtgttgttcttatggtccgagtcagtcaaaagttcctatagatataagatagaccattctgtagtgttggttgatgctgtcaggtcaggagagttaaccacccagttctctaaccatgtgaccaacctggcagcgttgaggaagtatcatgagagttacaatcttgtgaaagtacctaaggggtacaagcctattgaaatggctcaagtcaacgtgtttggcgacgacctcaatgtcgtcttgcgtaccagggacaggaagcctttcacattggctgatatggaaggatatcatgatcatacatttgagaaggccgccgagtatgaattcagcatatctaagaagaggtcgatgatgagtaatgtgataactgaacacatcaagcaatatttcaaaatgggtgatgtaatcttagacgtgatgttaagcagtatgacgagtgagaggaacaccttcagggagcagggatatatgaatggcataaatctaatatatgacattggcgtaacaataatggcacgatacgcgcagaatgataaagtgtttgaggacatcattgctagtatgcctttcctggaaggagtcgtatatagacatggaactcagaagtaccatttccacccaacacccatgcatttactaggttctggcagtcctgaaatattgccatcagccatagacctgagaacttttgcacgtataataacaactctaggagagcatgaaagtgacgtgtatgatctgatgagctcactcaacgctactttgttatcaagtgctggggcatctcaatttgagactcaggtgaggagaatacttatggatgagttgggtgatggggtggtatcccctatatggagcactgttttctttagagaaggagatgatccatatgatattcagacaaaacacgtgaagttaacgcccgaaggccataaggactaccttgttgataggatcatatccactttgtctaatagagagaagataataatgaacagtgctgatataatagaaaaggttttatctggtaagctcaagagggtgaagagatatttcagtgagattaaattcaatttaaagaatatgcctactactggtcttcctaatagaaaggtcaatggtgttagtgaattaagtagtccttacagagccgctgaccttggaatgcgtaaggtacatcatgtgattgggctgtccagtaacaacgttaaaataccatcatctactgagagtttgagtaagttgttgcatggctatggcctagtctcgcaagctgattcagctaaaatattatccgctgcggccggcttgggtagaagtacaaccaaatataagcaattaggtatggatctcggattgactgagatgcacgctagccaatttgcattaagattgccctctttgctgactcagtatgaagtagaaaatgcttctggttctttcaccttctatgacaccgtgtcacgcacatacgacgtgtcggaggaaagtatgaacaaaagagtgggagacgtgcttacaaaccctctatcaagacctaagtctaacacctccagctactatagactcagaggaatgttgctgtgtctttacggagctaggtcaggagcttcattgcatgctactgtggagtagtaatgatgatcactatgtactacatatatatccacttgaatcgatgaca

SEQ ID NO: 56 - DNA, 1317 bp, Unknown
  derived from dsRNAs of unknown virus
gaatttcgaggtacacatgagtttctacgatgtcgatctctagagtaactaaagatgcggtcaaagaaatcctggagatcactgacaacttagcgataacaacttcctcgactggcaacattcagctgggtgaaggtgcggggggaatagcgaatggtactggcgtagctataggatatcagagtgcgatggtatcaccagatcgcaacatggttgcggtagggacagcagccctatattccggagcctcagagtatgccgttggaattggatacttcgcaggaatgaataacgcggaaagagaaagtatctccattggtctacgtcccaacacaagtggggcaggcgcccgaagcatcgggctggggagcgagtcgaattctagcggaactcaagccatcgcgattgggatgcttgcgaatggttcatcaacagatgcaatagctgttgggcgtcgcgcgcaggccacggcaaacgaggctgtggcagttggacatgatacggagagctcagctacgaaaagtacagcactgggtccgggcgcgaatagttcacatgcatcttcgaccgcgattggagccgatgcaagtacaaccgcagcgaatcaagtagtggtaggaactgcggctgattcggttcttatcccaggatcgcttaccattagtagcaatgtgggtgtaggcggcgacctgattctttctaatcggttgacgacgacgctgcaaaactacatagcaatttcacatggctctacgatatcatacgccgttggatggcagggtatattcccatctgcgtcaagctacacagtcaaacttccagcagtattagcgtggcaggatttctcctcggtcacctggtatgtcggtcagaatttgtataatttaaaggggctaacgaacgtgtctacagaaacgttccttgtaacggtcacatgttatctggaagtgggtagtagtggtgcagctcacatgaacatcggcaagctaaacactggtgcggatgagtctggatggggctcaatagaagcacgctccaatacagccaccgtgccagcactgggggcgaatacactaacatgtacggaagtgttgcaaccaggagaaagtctgcagttcgctacttatcaaagtactgccgtgaccaaggcagtgcccaatcatcgtctgagagtaatggggtgggtgcacccatgaaatgggtcttctcaccatgctgttaatcaccaggccgttatactgcgtcatagccgcttaagatcgtgcatcaaatgactagccatcatggaagctgcctgtgtcacacgttataaacatc

SEQ ID NO: 57 - DNA, 1692 bp, Unknown
  derived from dsRNAs of unknown virus
  misc_feature (150)..(154): n is a, c, g, t or u
gggaaaactagacccctttgaaaaatttctagttaactgattataataatttttatattattatatattagttccttccactcggagatacctatgttaactacagacaacttatcaaaagttttctttagaaacatcgccattttaaannnnncgcgttcatccgttgactccctttctaagggttttcgcttcgatactgttattacttctcactcatctcgtactaatatccctgcgccttttaaacctttcatagaaatgttaaagaagtcagctcctatgtacaaattagatagtgtttatccgacagtgaaagacgttgaagaatctgatgcaaaagcatttgaaaggtactcttcggagaactttactttccccaagggcaacattcttcggttgctacttaaatccgcggtcctaaccgccactgatcttggtttagacaagatcaatcatgagaagatcgaccttgacgaggcgatatcttccttctcatcaacaacctcttcaggctatcccacatataaaaagaaagggaccgatgaggctcaagaccaatgtaggtctttcttttctgcgtttatgcgttctccatctccttctaaactacttaagatgccaacgactgtttttcacagatttcagtctaagtataaaagaaagattgagaccaagatacgacaggtttgggctttacccttttgtatccaaacgttagaagcattctacttccgtgccactattgatggcgttaaagattttcttattaagaaggatctaccatgctctacatatgggagaaacttgattagtatctcttcttctgtgattaaaaagttcagatcttataacgttaggttattttcggctgacgctgaatcctttgatagtagtattccattctacttcattgcactattctttgctgttcttgaactagtgcgggatgacctaacacgcaaggacgttaaagctttgaattctctgatggtttactttacgtttaccccttatgcttacaaaggaaacaagtttagacaccaaactagaggcatcccgtctggtagtcttttaacttccatttcaggcacattcttttcaagaatgattgctaactttgcgcatttatggtttactgatggtagatacacagctaacggctttgccgtttgcttgggcgatgataacctttttgcgttatcgcatatcactaaagaacaaatcatatggacataccagctctttggtcttagtgttaatgctgagaaatcgtttgagtacggacctcgcgaaactattgatttcctcggatataaatgggatagagaaaataggcctactcaagacattgagtggtttcttgtgcatttctgttatcctcagagtttccttaaggtcactaacatacctcttgcactactacaaacttacagagcgatttcaatcgctgctcctttgtatggagggatgaaaatcttcagtcgttatatcggacggtatgacgtcgtttacaaggttatgttatccaagcttgctcgcggagaagaagtatctatcatgtatgtcggtgaagacagacgttttgatagagttgtcgtcccacttagcaacattctgagcggaggttggaaatactaccaaacacaacttactgtgtagggtaggggggaaggttctccgccttcaccc

SEQ ID NO: 58 - DNA, 2360 bp, Unknown
  derived from dsRNAs of unknown virus
ataacatacaagcactagacccatatctcgtatcatattgaatgaatatgcaagcatccatcgattactccaatgtaagtaagctaacagcaaacaacctgcgtaactcgttaaagcgtctgcacactacgtcatacgttttgtcaattcgtccaaccgatatggatccaaatgctatacttatgggcaaaagtcattcaaagatattctgtatcaatgtagatgatgttggtaaaacaatgaataagtataagtgggacgacaggaaaatacacgcgtacataagcgcagtatctcaaacaccagaacacccacaacgggctaatgtgccaccacagttctgcaatccgccacactatccagccattcatccggaaacaacgtcaatcaactatgataacgtaacattctataacaatagctgggggtacagctgggagaaatggaagcaagccgttgataaaccagctgtgtattggacaaaggaaaagcataaagacgatccattcacccgcgcattcaacacgatacctagtactcgaatggctgttcaaagggtgtatgaagatgtgaagactatccagcaactgtcggacgaaatcatatcttacatccgtgaacatcagaataaggctcaggtacacatatggatacaagggactctaaccgataagaatggcagctaccgtcccggcgatgtaatatcctacgttcgtaaagaattgcaacgacgaggcactaacccgggcgacgtttcatactattcatattggtccgacagcaggccacaggatataggagtcgcgtatggtaaccggcgtccttttcgcatgccaataataccatggaggacttctaacatgggaatgttgaaatttggcaatgcgaacctgaacccccagctgtttccagcaagtacaatacaaacacgtgggttgattaacgccaagcatcgactaccagacaacgcgcgttactcgaattatagtgaattcgtcaagttgattccaatgagcctaccgccgaagtttgactactactggatgcaagttggagaaaacgagtacgtaatgcgcgagtacagagaggtgatgcaacgcacggcatcgccaatggtaatcgtactgccggctggaagtgggaaaacaaccatagcttcgaactctgatatactggtggacatagatgacgtcttcgagcaatccaataaacatgatacaatgaaagatctaatctactccgctttggaaggatccgactttaggggtcaccccgccgtattgggcactaaaaggggcttcttaacccgttcagagaagattgcacttgtggatgaaggcatgccattcttcgttgatgggacatacccacatatgtttcccgactccgagctggacaagctaacgaaattcacttcggtgcacgcagcctcaggagagtttcaaggtaagaatttcgatgaccagacagacgaaaagccacataaagtggatgatatatacacgcatgaaggtgagcgatatatcatactagatcactcggacaagaatgattttacgcgacagacacgtgaacacttcgagcacaagttaagtgacggtgagggcagctggagtcgtgtggagaaattacaaacatccatgttcatggagcatctgagaaattcagaggacgcgatgcgtaagatatacctaatccattcggatgaccagtttgatgcaactctcaagccgaagatcttattcagtgccaagcccacagaagaggagattaccatcaccgccaatgagcgcggcgaaggtgaccaccattggaagacggcgacattgatgaactggcacacgagcgatgctcctataatgacacgtaatgaaatagccgaagaagtgactaaaatagcgacagccgagacacttgatggctttgcaactctttatgaagtggaagattcatccttctttttaggtttaggttcggtggtgacatcttctcatagatatttctcgatagggagatcgccatccaacctgctcgagcaattcctcaggaaggaatcagggaaggaggacctttccggacatatgttcgcatcggtattggctttcaaaagtcacttcctttggtatcttgaagagatagctatcaacatggaaaaatcaacaacgatctatgctttcccattcaaggagccgaagggaaagcaatatcattcaattaatgaatacagagattcagtcgtgtacatggaacgaaagttactacccgaatatcctcattatgctagagataatgttattatttgtaaagagttagtaagatctttcaattagtctagaagggaatgcctatgtttaaacatc

SEQ ID NO: 59 - DNA, 2069 bp, Unknown
  derived from dsRNAs of unknown virus
  misc_feature (857)..(863): n is a, c, g, t or u
gaatataaacactacggtttttcattgttaagagaaagtactttacaaagttataatgtctatcaccgcgattaccaaggaatacgcgattgaggtggctgacgctgccatcaacggattcactaagcaagcccgtggatctttgcaggcgccgacctctgctgaaaatgttcgcttgtttactgcgaaaggtggttctgcagtaacgctcgagtctgctacggactccgccgcagtggttttcgatccagaagcgtccctcaggaacaaccaaatgaacgtcatgatctacgaacgtgaggacggagtggtgacgaaagttaagagcgttaacctagggcgtccgaccgaagagtttctcgcggcgggaattatgtcgtctggaatgaaagtcttcaactcctctggagttgacgttattggcggtacgcagagtgcggccgtgctaacctctgtgccccgcgatatttccaccttgtcctctacggatgtggctaacttctgctctaatcacgatcgcgatctggccagcggcgtggtgtctcgtgaggacgctacgatgaccatggttatgactgagcatttcggaaagaagatggctttggttaggtctaacactacgagtaacaccgttcaacgtacgtggactgatgggattggctcccgccgctcaaccatcggtgactcgctgtgtcaatacgttgcgaacgaatcgactgcgtttgactctctgtccgcgtcctactctgaagctgatcagatttccggcactggtaggtatgtgctggatacggacaacctgtcttcttccaagaatccgctgaccttggctacgtacagcgtggacgttgttacgnnnnnnngctttgatgcacccacgacgaccgacgctgattatttcttgcgtatgacggcgtttgctatggatgccagcggcgaggtgattgctaagcagaatatttcccagactaagtctgtgattggtagcacgcaatttgtcgcgacctattcggcttcgcttagcagcacctccaagccaattgcgcgcgtgatcgtcaccccgcagggtgcgaccgttgtccaggcgaaccttactctcagtgtggttgactcgttcggtaccgtcacggcatttgaggagactgccgacatcccagctcgccctgtccatgtgtgcgtgctcgagggacttaattccggagcgactattaacctcaacacttacgccacggtcacgggtattcctgactccactaacgtgttcattgcttcggcagttgaagcgagcgatacggtggatcctaatctagttgaagtgttcctacgcaccctgtccaaatccatgccgcgtgcgttcactgtgggagggcacggtgcgttcactcgccagctgctggctacgtttaacgaggaacccgttgagctgtcctttaaggctatgtcgtttgcaaatgtgggcaagggtgttaggcagatcgcctcgctggctaagaaaacgggccgcgatctagatgaggagattaagaagcattcttccactatcagggctgttggcgataccatgtccatgatgcctgggccggtaggcgatgttggcagaatggtgaggaaggtgccgggcatgctgggagcctgaagcatgagccatttcccaagtgtgacagaagttaatggacgcttatcgcctggtaggatacatacattaattatatctaacacgccgttaaagagagcgtacaaaagacatggtaatcatatgtttgacagcaatcttaaggatgttggaacagaattgctgacaatactctcaaaatatgctcccagttacgtatcactgcggcgtaataatataattgaaggtagatcgtgggaaatggctgccatacatggatttcttggtgtaccaggtatttacagtggagttattaaccatatacatcgaaatcgcatccacttcggacccgttatgggggtcggtgtaaaacgagaactaggaaatttcttaacatatgaaaacataccatccgttgactttcccggtcaataaatgaaacgtgttttgaaacatc

SEQ ID NO: 60 - DNA, 1544 bp, Unknown
  derived from dsRNAs of unknown virus
aattttaaattaatacataagttagcttcaaacgccaactatgaacaaaataacagatccatacgcatacaaatactctatcaggagttaaaagtttgccgctgattttgcaataagtgaattcttaaaacaattcagtgaaacaaaatatcgatactgtttacagtactctaagagaattaaccctcaaattggttttgaaaatttggaacgtttcaaaattccattcaagttcagaccaaatgatctatcgtatgatagagcgctcaaaaaagtagctttaaagctaaagacttcctaaccgatggcttcttttgaagatgtttatcgttaaatggaaatgtccaaagctgcaggcttctcattccccggaaaaacaaagggtgagatcatatactcagcccattgcaccgctcattatatgtcacacatgatcaaaaagggtgaaaaggtctattagccaccatgtaaggtagcattcagaggacatttgaaaaagattgaagagcccaaaactcgtccagtcttaatcatgcccgttgaatcagttatcttagaataaatcattggtcgcaacttagttaaccattttcgtgacaacgaaccagatatcttctttggaaaagattcaatgaagaaacttcatggcaaagttaacgcacaccaagaaaattatagactaactcttgactggtcaagattcgacacaactctaccagcttttctacttaatgacgttttcgacatgcttcgtggttttatctcctttaacaagatgaaatgcgatgatgagattatcgaatatactgaaagtaaagctcgagagtatgaaagaatttttgattgggtgtagtacaacttcatccataccaaaatcatgctgccagacgcaacaacatatcagaaacattctggtataccttctggttcattcttaacatctattataggtagtatttctaatatgattatgattgaaactttgttagataggatgtaaatacgcagtgatggtattgccgtgttaggagatgactctttagtcagcctgagtgaaaacgcattcaacaggttcaaatacgacacgatgagagatgaagcacaaaggatgttcggaacaatagtatctgatgacaagatgaaggttgcaaaacctggagaatctgcatcatttataggctatacattatcaggattcaaactggtaagaccaacaatggattggttccttagcgcaatgtgtccagaacgatccgtcacagacatcaaaattactgcaagtagattgtgtatgtactatcatcttggaggatgtaatgatgaattattctctcgattttgtcgcgaatttttcgaattacaccagatgaatccacaaatcgaatttatcagtgatgatgcactcgtttggtttatcagcaattacatggactttgattgtccggctgtcggaatcaaatatgctcagaaagctagtctaggagcaacaacttattttaggtttgatctatgacaaatttcttctaaaacaatttaaccccccc

SEQ ID NO: 61 - DNA, 2285 bp, Unknown
  derived from dsRNAs of unknown virus
taaaatctttaagttagctcgtcttttgaagagtgcaaaaagtcgctatagcaatgttggtaattgttcagacagccgaagaagcagcgatccgcgccctttggggtaagcagattaatgaacttagaatagatgaagataaaaatgtcgtttggaataaatcgaaaggacctatgtccagtgatgttttcacttttacaacgaaattgattgaaccatttatgttgaatatgacgattccgttatatgttaaattgtcagaacgtgatgatcgaaatgaatatatgattgttgggggtaaaccagtacgtgctcacgtagttgttccgcgtcgcaaaggacgtgaattagttgattggctttctgtccacgatgcgtggatcgaaaagtgtgatgcagctcgacgatcgggaggagaagtgcttagacagttcgcctttggactaaaccttccgatgaatggatctgagattgagtctgtatggatgaagagcatgttgggcttcaagaatgagctcaatggcattcgtccaccatttcactctcttgttgtaaatgatggtattgtttctctgcctcggttgaaaatgttttgtggatcggatgaggcgatgacttcaatccctaacgacaaacgcggcgatgagaagctttttagactactcgaagctacgtgggagcccaacgagtacctcatttatgttggtgctgcgccaggccactcgattcaacgtttcctgaggaaatgtaagtcgccacgatatgcaacgtttatagatcctcgccatattaatattgacgctagaacctttggttctggtgaacaaacgattgaaattatcacgggtgaagatgggtacgccagtggtgtactcattgcagaactcgtcactgaatggaaaaataaagagaataagaaaaccgatagaatatatatcctgagtgacatccgtcgagagaagaccgaagcaacggatcgtgatgaatgggttgatttagtcaattgtgatgaagagatacaaaaagactttgttgaagttgcgagagcatataatgttccctttaagtacatgctcaaaaagcgcatccctgacgtggatgatgatagagatattaccttgtatgataaaaactgttttttgtttagggccgcgtattcacgccctgatttgtatgaacttcgtgagtattgcccgattgctggaggtgaggatgtagaaatatcagtcacacgtgatcaggccatatccctgcatgttgatggtacgagaaataacttctcacgtgagcaacatgttggattgatgagtttgcagataaatgatagattgacacatgacaagttcgtgccaagtgttgatctattctatttgactaataaaaggaatgcgtggacgtatgagtctttcttagcaaaggcacagactagcgctgttgctacgtggtgggtctcagatacgatacctgaaggatatgatgatgtacccattcctagttcatggtttacacggatttccgacgaggtgtatgatgtttccgtctttgatggtgatttattcacccttgctgtacaatcatacagaggacagatgaataagacggtggattacgagtggcaatcccatttcgtggtaaccgtaaatcggaatctcttggctaagtcggatcctgtcttcaccaaagagatcgaatactctactgatgcttacttttcgcaatcccgtgggttacgtgatggagcgaattcttacaaacgatttgacccgaaatacgccgcgaaatttacccatctcaagggatggtccatgttgcatcataaacgtgatctctctggacatctcaggatgatggtacttgatggcgtcgtacgtaattatgatatggcaaggtggatcaggcaagtctacgcatctaatgtgatgaattctgcgccagacctcgattcttgggatctgatggacccgaaacgtgcgatggaagctcagaaacgtgcccaaccttatgaagcgaagggtattggaaagatctggcatacacgcgatgacctcgtttggactctcgcagctctagaggttatgttagatggtgtgtcagacgttgaaaggaaagcttatatcccccgtggtatagtgttacaacagctgaagacaagtaggaatgaaatagatcgtattaaaggtctctttcccaactagcggttgctatttcgggaggcagtctgacgtttacttttatctatagtaggtcggcataccgtagactagacttatttagatttttgaaat

SEQ ID NO: 62 - DNA, 1301 bp, Unknown
  derived from dsRNAs of unknown virus
gggtagtgtcctgttggatgtcatgttgagtagtatgaccagtgagagaaacacatttagagagcaagggtatatgaatggcattaatcttatatatgacatagccgtcactatcatggccaggtatgccaataatgataagttatttgaggatatgatgattaatatgcccttcatggagggtgttagttatcaccatggcacccagaagtataatttccacccagcaccgagtcatctgctaggttcaggcagtcctgagatcttgccttcggccatcgatctacgcacattctccagaatcataacggttcttggggattacgagagcgatgtttatgacgtcatgagctcacttaacagtactttgctctcaacctcaggtaccacgcaatttgagtctcaagccaaaaagattctctgtgacgagtgtggtgaagaaatgatttctcctctttggggagaggtattccgtcgtagtgaccctgaatatgtaattgaaactaaacataccaaattaacacctgagggacacaaagaatacctggttgatagggttgtatccacactgtctaatagagagaaactgataatgaatagtgctgacattatagagaaaattcttacgggcaaattgaagaaggtcagaaggcatttcactgagatcaaatttaacttgaagagcataccacccacgggattaccagatagaaggatcaacggtgttagtgagctaagtagtccttacatggcggcggataccggaatgcgacgggtgcataaatatataggtctatctaagtctaatttcaagttcacccctaccacagagaaactaagtcggatgttgaagcgttttggtttgatcacacaggctgactcagctaagattctttctgcggctgctggtctcggtcgtagcgctactcgttatcggcagcttggccgtgatctgggattgactgaaatgcatgcaaatgactttgctcagaggctgccttctcttctgacccagcacgaaattgagaactcatctggctcttttacgttctatgacactgtgtctcgaacatacgacgtctccgaggaaagtatgaatgtgagagtgggagatgttactctaaatccattggtcagacccaactccagcactacaacctactaccgctttcgtggtatgtcactctgcctgtatgcggctcgccatggcctgtcgctacacgctagcattgagaactaatcaatgatgtctgcaattacttcactgattatatctgcacttctgttttggactgataaca

SEQ ID NO: 63 - DNA, 2776 bp, Unknown
  derived from dsRNAs of unknown virus
gggatttaaaattaactatagtcgtcgtaatggcgtcactcacggatagtacgtctacagttcaattaatgttatcagaattaaggaatatgacctttcgaatcagtggtagaaagggaaagtacaagaattatgagggtagagattatgtatcaaacgcagtgtattattcacttggagatggatatcaagcagctctagaaggattgccagtgcacatcaaagatacagagatattcaggaggtttcaatcactcggtttcagaactgacgagcacggcactggtttcactgcagtactcaggggcatgttgccagatttgataaagaataaaggaatacgtgaagtgcaaggtgttgacacacagactatgcgtatactaagtatttatgatgtgaatgatgttagtcttaaggatatgtacgttcctgtaacgggtcttaacttcattggtgatttcagaaagcattgtgaagaacgcctgaatattccatggagtagatcactgcatgtcacactgctgagattggctaagtattatgaagactttgagaacacatttgatgatatagtggggttgaagcctgtaccattgccaaattttgaagagagcacgaatggatacagtaaagttagaatagccaagcttgagcctacatcttatgtgctatttggacctccaggtataggaaagtcaactattgttgaggaattgaaaggcttagatttagaaggtggtaaagcacttgatgaggcttacaaacgtgaatatccagtaataggagcggcgggttatcagcctggtgactttgatccaactagatttacaaatgtgttgttgtttgatgatcagctgggttatgagaagcgcaggttagcaagggatttattgaatgctgataaagctgatcaaccttacatgtatatgagtcagttcatgcaaggtgatggctatgatcatgttgtgtattcaagtgccagtaacataactagtttattaagcactactcaggttagagatttagaattagagtgcttgtatccatctaagtcacccgctataggagtagtgttgggtgatggtgtaaagaagaacactatgtctactgttggtcttgtgtgtaagcataatatgctgataacaattggagacagtccagggcctcactataagaactatccccacatgcgaggtagcacttattcatgggatcctgttcctcctgaatatgatactatacacaccttagacattttcacgtatgatgatgtgcctaagttaattgctctcattgaacgcaacagtaataaaaacattctgttgaggatggacatcagagctgacaggccggaccaaccaagcgtcaccaaaagccaaagaagtcgtggtgtgaatagagggttatcacataagtttgaggttaacgtgcataatgataacctcttgatgacacatatagccagatctgtatgtaattatgataacgtaagtttctctgttaagctgagaccatcttatgctaaggagttcaaggactttgtcttggattatggttgtgatgtgttgatactcccattaccatacacagcaccaacaactatggaattgaatgttgtgaagttacgatcaggcatgatcagggaatcaggcttggttcgcagtgtgtcatatgatgatctgatcaaggcacaaccagaattcattgctttaaagaagttatgtggccctttgtacacgcattttctaagtgatgctcactactcactaatgattgatgaggttaagttcacaccatcgaacaatagctttgccagtttctctatgtccaacattaataatccaagtccatacagcatgatcatgccaagtaacttcctgtacacatatccttatagcgttattggtgatagtgagcacagctttacaactaggaatagaaagtacaaagaccacactatcagtctcaagtttgaaatatacaatgaggagttgtttgtgactcctattaatgcaattggaggtggtcataacgctggtgtacatggtagagacatcacaacagtgatagtatctgacttccctgtcactagatttaatcagcccgaaggctcattctccactcaggttgttaagttggtgtcagctatcatgaagaaacgctttcctaggtggcatgaaactgacaattccataagggaaatagcgatgaacaacgtagctgacaggtataataacataatcatacgcattgggggaggcagtgctttgcacaacaccaagatgatgacatcatcaggccatgtgatgtatatattattgggctcattgatgggtataccatatggattctataagtatctgagggaattggaaattaacatcaagaatgatgatgttgggtatgagaggaagtctggtagcagagtgtggcatggttaccttagtcacttatgcggagtagaagccgccagaatagctgcatccaagttattcagaatgactactgaacaggtagatgtgtttaacacagcttgttctatattctccagtaggatagcatcatatgcaaacaaacatcatgagaaatatattagtgttgatgagacggacactatccattgagatgattgcgttacgtgggttcagacacgtagtctgaattgaggtttatcgtccttagtgcggttgactgtgatctcctcgcgctttggatagagatactctgaatgggggtctcgtggaacctctgccggtagcgactgttaatgattaca

SEQ ID NO: 64 - DNA, 1852 bp, Unknown
  derived from dsRNAs of unknown virus
agataaattgtttcaattgacaaatgttgagtattcttgatactaacaaacagatttagttaactgatgagttaactaattttcagaaatatcaaaacatgcataatgattatattttgtatgacccagaaggagctaagttaagtgactttatagtcgatccatttcctaaggatttcacgtacaattacggtgtcgcagctggaggataaaacattaatccattttgtaaccacacattaaaagagtttaaccctatgtttgcgcacgaacacgataattttacaaaacaaccacaaatccaaggagtaataagatcagttacgaattttctaatcccagataattctcataagacaaagaacggtactttaggtccaatgcaaattcatcatgacaaggcaagagaaattgttcttgataaatttttgaaataaatcggaggtaagtaaaaaattttatatttacacactgtagttagagaaaaaatgaagaacttgacaacatcaagtggattcacgcactatcctttatcaaaaggagaagctattgattctgcttatatgatcgcacgtgctacacagcacagattgaaggctggttattgcgtagagaaaggcatttgtctactcgctgctagaggacatctttccccattaaaagcaacaccagaaggagaagaagttaaaatcaaatccagaggagtttggaatattgatttgtgtaatattcttcttgaaatgagattcacttcaatgtttaatggaaaaattgcttgtaatgttccaggagttaaaagacattttcacatcggtgaaggtgaaatgcaggcaacacaaagagtgtgcgaaaaacctatttatggtctaggataaacaaatttagagacagattattcttaatttgattcgacataaccagcatggttattgagagaaactctaaatgatctatacgattattgtttagatttagattatgatgaaactggagaacggaattctgaacttcagaaaatgagaactcgaagagttttcgacttcgtagtcgacgaactaattaacacacgagttttattaccaccaagaaagaaagatcttgaagcaaagaaaatgattgtaattcaaaaagataaaggtatggcatctggagccaattgcactttattagtgaattcaattaacaatgctaaagctatgcttgctgtattcggttacctcggtcttgaagttgctgattgggtagtaaaaggtgatgatggttcatggtttcttagacataagatcgacaaaatgatgttagagaagattgcaaaattattaaagaaatattacaatcttactttgaaccctgaaaaatcaaaaattcatacagataatacaacacagagaacgtttgctggttacaaattttaaagtgaaactctaaaaatgagcagaacagagttattcgctagacttctttatgttgaaggaagtgtcagaacttacgctgaacacttgactagggttgtctcatacttaccattaggaggagtgaactgtcctgagtatatgagatattttcaattttgtgtcgatagatttccgaaagaagagatctaataattcatgtttaaataaactgataaaaacatgatttatttcaacagtgtcatgggattttagtagggcatgttattcaatttagagtagatcgatctttgggagatgaaatatatgttcagaatgtcaaaagacaaatagtctgaccattacaaaggtttttagcctgtgaaagtttttgaagaatctttatataataatgattattttaattaacaaacattatgagggatttttaaaaacccccc

SEQ ID NO: 65 - DNA, 1257 bp, Unknown
  derived from dsRNAs of unknown virus
gggccagcagatcatggaattcctcagggtgttgtttgacagttacggggcaacgggttacttgatgaggtcagtagctacaatgatcgagcagcctgtgcaagcagctgaagacactgctcctgtcgcgaagataagctcagcgtgtgccggactccacctgctgtatcgtcgtggcttgaacatggagtgtctggacattctatacgatgtgttgatacgctattaccaacgtgtgcgtctgccaaataatcaggccttcctgctcccaactgccgtgatcaagagaagttatcctgatggaggcctcgacgtcggattgcccaccaagtgtgtgttgccggctaagcctgttccttccctccctgctcccagattcaacacgaaggggctgtcggaagttctgactgaaacccacgcctccaataacactgtcagagttatcagtgaaatgatcaaagaggccatcccggcagacaagatcagagagagtgtacacgagaataacctaataggatctatctcgtcaaccagcgtgaagcggtcactgcaggcacatgccctagagctccacaagtatgtcaaatcattggcggcagtggatccacctagggaggcccaactatatgacttcatcttggacgagaaaaatataccaggctacagagcactcgacctcttcgagttcttgacccacggtgaacacgtggagaagatgcagaatcaggagacatcgttcctgagtgccattctggctggcataggggcgacaccattcgaaggggtcgaccagatctacagcctgcagcccgagatgagtaagtgtgatgccatttgttgggctcttggtgtgtctaaggcaaagaagaagatttgtggtatagcattggaaaatatgcgtatcctgagggaaaacacaactgaccaagtcacgctgagaatattgagtggtgtgagggtccatggaatgcggtttctgagttatctccaccaggattggctgagctgggtgtctaatgtggccgcccattttgcagcccttgaggcgatcaggcttcgggtcaagcaagttgaccagtgggacaaattgatcggtgactttgagcgtgtctacctcgctcatgcagtgctcaggaccaacctgccttcattatcccgtttctagccgtgtcgtgtgacgcggccagcctaagtataaatcaaacggtcccagtatgggacttatgatcccgacctagaaggtctttcgtgaaacta

SEQ ID NO: 66 - DNA, 1708 bp, Unknown
  derived from dsRNAs of unknown virus
ataatatgttcaaaccatcttataaaaaacaaataagaaataaaactcttgttattgagaccaaaatgaatagcttcaacaatctagctaattggggttatattagtggaaaagtaaataacactataagcgatatttacaacaagcaagtcataagttttcgatcaattaccgctagggttaaaaattttcgaaaatatcaccataaccttactccaacaatcttaccatggcaagatttaaggttaagaaatttacatcctccaggtcttatgtgaccagtagcttttagatttatcaatgcaggtttttgtacatatgaagatatcaaaaacaggtatgtggaagttactaataatgaactcgtcttatctgatttagttgagaaaacagatacttataaaaaggaggcaaaatttatctttcgtttttcaaggtattgtaatggtcttaaaacattacataaaacaatgtttggcgataatatcgtcccaaaattaaataaaacgttagatccaaaagtaatattctcagcacttaataaaagagcatcgtctggtttacctcattttaagaaaaagggtcaaatgttgaaaaccgttattaaagtgtgtgatgaatataattcaaaagattacgatactatcgaaaaatattttcagttaccagcggtagtgtatagaattgttcaacctggtaagtcaggtaaattcaagaataggtatgtttacggtcctccaattgaggtaactattattgaacttatttttggttacgaggttatgaattactttttagaaaaacaggattcaggcattgtacttggaaaaacacaagtagagttgtttaatcttctccaatctcatgttgataaatttactaaaagtggtgactatagtaattttgatcaaacaattccatcatgttttcttctgacatgtttggatacgatttcgtatatgataaaacttgatgatgatttcgatttagctgtatatggattggtttcttcgtatatcgttaattgtaatctttaccatccagtcactggactagttaaacgtaaacaaggaatatacagcggatcatattttacaaatcttctcgattcaatggtaaattgtttcatcataggatacacttctgctttgtctactgactgcaaaatatttgtatcaggagatgacctttttattgtaagttcaaaagatattatctatagagaagatggaataattgaaattggtatgaagcttacaatggataaagaaactgtgaccactccggggacttgaggttttggcttcctaggttctaaatgaactgaatatggaccagaacgtccgttattacgaatgattttaggctctattttagttaagtctcgatgacctcgatttgatacaagggaacaaatgatcgaaggtagagtttatacaacttttggttttgatcggagattgccgtatttctgacaaaagttaaaactaaaatatccttacgttggtaggaaactctttttatgaaaagaaggtcaaggatgatcacgaacatcttttaaacccaatgaaagaccaaatgattcatggaccactggacgtaaagatgagtggaaaacacgttaacttttgtatattttgagtgtaaaatatatgggacaataataatttatttattattgtaaaacaaaactttatacgttttgccc

SEQ ID NO: 67 - DNA, 1819 bp, Unknown
  derived from dsRNAs of unknown virus
cgaagagagatgtgttcgaggagaccgtgactgacttgaagagtcggatcacgagaagaagactcaacacgcttctcagcatcccgacgatcacgggttacagaactcagatcagggaggaaggagaaggtgagaagttgaaggtgagacagatcttctgtgttccctttcacatcacagctctcgagagtctcttctacttaccgatcaaggacaaagctcttagttcagagtgttacttctcaaggtctcagaggtgtcagattcatggcactctcgctagacacagaggaaggtttcttacctcgatggactactcaagctttgacctgtcgttgcatgacagactcatccaactcgccttctctgagttggagactgtctacgatcttacggtaagagagaagaagatcttcagacttgtgaagcagtatcatcatcgatgtcgtgtgtccatcaggggtgagttagtgactagaaagcatggtctcttgtcaggttccatgttcaccaacttccttgggacactgatcaacctcgccatgatcgatgcaacgttaggcgacacttgtctctcacatgcctgtggagatgacaacttgttgatctcaactcatccactcaacgtcacacgactcaagaacgtgttgtctcaagactttcagatgtcagtcgtcatcgactcagagaacgtgaagtctgacgtcttcttcctcgggttcaggttccggggtcaagacaacatgtgtgttggatcacctcgactcatactcgctaaggcaaccttctctgaacacttccttgacatgtcatctgacgagagactcggtctcagagtcagttcgatcctgtcaaactacactaacatgttagagttagtgtctaaactcatcaaagacctgaccgtcagtgtctcactccccgaggagagagtgactctgacgtctgagaaggagaagttccttctctacaagaaacatcttctcatctaaacaactttagaaacatgaaacacaagaaactaactgtgtcactcagacacaacagacacatcttcgagtccatcgaggacaagatgtcttacaacctagttccgatgatgtcttacatccaacggaacttcaaacagatcaagcgtgaagaggatcccatcttcgttgatggcatcaagatcccaaggatcatgaacctctggttcatcatgctcaacttcgtcaacacatgtcatcgaggcttcaagaccaacaggtcgggagagatcgtcacttggaactacacaagtgatgacttcggagtccccgagacagagttcagtcttgacggatggctgaagcatctcaaccaagcaaggagggacgagttccaggactttctgtccgaagtcgcgacctttcacacttcgatctgttacacgaagaccgacttctttgacatgaactttctcacacatgggaagatcgtcagtccctctttcatcaagacagacagagaggttctctcttggctgatcagtcatccgatcttcttctgtatcgaagaagaccaacggatcgacacagtcttcgagaccttcttctacgagaaagagatcccagagacgttacgtcaagagtcatcaaggctgatcgccttactagacaccttaacacctgaaagggtgttgagtcactacaagaagaaactaacaaagaaacatgacaagtcaaccaagaaagttgaagacagtcgtagtaacaagggagggagtcaagacagttcatagggtctacacctccggacaagtccgcactaaacacgttaagccttagacgcgggcccc

SEQ ID NO: 68 - DNA, 768 bp, Unknown
  derived from dsRNAs of unknown virus
ggggccgctctagatattattcacgaatggttcgacatgggtgagtttgattctcaaattcgccgaaatgaaaatgtgtgggcggtggttcgcgagaagctaatcaacaccacactattattaccttccggacagcatttactgatcaagggcactgtacccagtggtacagagttcactactatgatagagacagtccaagctcagatcgctgttgtcttctctctttttgagatgggctttacggaagatgagatccgcggtcatttatatggctgtggtgatgaccaaggctttggtcttcatcgtgcggtagatacggacgtattcgctacacagatggagaagctgttctatacagtcaagcctgagtcagtcatgcaatcgcgccggaatcgagacattaagttactcggttattatgcgtatgcatggcacccacacagaccagagtgggaattatggagagcagcgctctttcctgaacgctatgtaggcaatgaacaaaactcattacagagaatcattggccaaaacataggtagtggacagtgcaatgcagctttcgatcaattcgcaaggttatgtgtgcagcggtcttggttcttaccagccgccgagccggatcgtggccaattgaaatttcataagcacgttctcggtatagatagaccatgttacggtggtcttgagtgggacaccttcgtactaacatagtgtagtgcataggaatacaccaccatagagctatcagctcaacttaacatt

SEQ ID NO: 69 - DNA, 1432 bp, Unknown
  derived from dsRNAs of unknown virus
gggtgatgacgtcgcactgataggtaagaattggttgcactaggtaacaatcaaccagatgctaaagatgcatggccacgagggacaagatctgaaagtaattaacgggcatgagcttgaattcctgaggaaaatgtatctgagtgacgggtcaatcaagggttacttgaataggagcatacctaatttagtggcaactgatttccaaaatgaagacatggagaaagtggatccagtgcaaagggcaaaaggcttgctatagtaagtaggaaaatgcaggagacgcggcataccttacaaacaggcaaagataattgaaatggattacctgaagcagtgggcaaaatataaagatgcaaataataaatcggtgccaattgagattgaatatctgacgactagtgtattgctaggtggggcaggttgttcaatgatcaacaaggcaccccagctacaaaatgtggaatacagggcaaaactaccagtagtacgagttgagaaatcaaacataagcagtagatcgtacgagcggtggcaaaataaactggtttctgggagcatgggcttaaggttagcaggcaacaaagagatttaacttgcaatgctaccctagaaataggctgattggacaattaatgccagtaagaagcagatggacaaggcaagggaggcagcaattgcacaagtgtgtgtgaagaaagtccagaggacttacaacccaggcgagaacgtggataagatgtaagcacacataatggcagtagcgagataagacgctaatcagttggagagagcttggacagataaatcgaaggaattccgactacacacaggtgaaacaccaccaattagcgcattcgtgaagaaaatgctgactgggacgataaaacaaccgcagatgctaaaaacagcatggtatggttggacaaagtcaggtaggctaccagcgtggcattaggcaacgtgggaagacatacttctattcgcaaggtttgaacttgatgtagggaggtatgcaaaactgacaaaaatagtggaaaaaatgtaattatacataaaaccacacacagctatgacaatgctgttctcatccatatcatttgatgacgtaagtagatagatgatagatgatgagatacagagttatgcaagacattgtgcattgcatgcgctcgcgagatcacggtactagttatcagtgagggacgtacaatttatagtgcgcagatatgaaacggctttctataggcagcataggagaggagaactctacgctaagtggaagcagtgaggaggttagaatgggaccaatacgatataatgaataagtaagtataatatataatataaataaaataatataatgtaatagtagtttataagttcgagttgtagaggattagcctccgccccataaggggtgtaacccgaa

SEQ ID NO: 70 - DNA, 2114 bp, Unknown
  derived from dsRNAs of unknown virus
ttcatagctgcattcgatgcttcggctcttgatcagcacataggtgttggtgataagcaggtgttgaagaaggttatcagaaagttcgaatcctgggctgccggatctgttgagagcggggttctgtccgaagggctgtcagaagaggagttacgattagcccaaggcgatgcttttgtcactttgtttgggatagggttcttcacttggctaaagggctgggtcactaaacgtatgaagaactacttcactattaaagttaaggaagcacctgaacaactatttgagtgtgacactaccacatcgggagatcgtgtcaccgggtcaacgaattctgttaagacgaaggcatgcgtgcaatggacaaatgaacaagttggcttaaattctgaaggatccactggaggcgtgtggggagatgacgtctggtgggcgtttttatcacgcgccttaactccagataacgttgtggcgaagatggaattatgggataaagcgtctaaaaggtgtggtcaattatatacacaatctaaagcgttcagtgggcggatggtgcactatttgcaaaatgtattcattggagggcagacgttcgctagacctcctgccttagatcatgagaactggcagcctggtggattgtctcaagtggggagtctactagacaagctggacaagatgtcagttcggaatgggcgtagagatgggaaagtgtgtaatatatggcggctatcgtatctagtctgcagtgctcaggttaatgtattcggcaagacatttgtgtatgatagtaaaatgtttctatgtcccggcggattattaaatcgagtgctactaccatttgcctccccaaactcaaaggtctggctgagcatgaatgctgctcgtctcttcaataggaccgacatcttcaccgaacccccaaagcccgagcaagatagggacataggagccaggatatggcggaacatcaacccgggttcggaggtacagattagtggcttgaggtactcagtcaccgacttgaatgctatatcgaaatctagtttcaaggtgttgtccaacaggcaaagagttcagagcgctgacctaggaccagctctcaatgtaaagtatgataaactactcaaagatgctacatataacgaatggaacactaatgtagcaaagactgcattaggttcgaaaatacggaaaggtccatacgccaactggttcttagaagaagaattgatacaagttggcattgtacccgacggaaaagtgaaagaggggttggtgagggaccgaattgcaccaagaactaaaaacgtggtcccaagaaccgagtatggtattggtgattacttgtgtacactggggtactcgggatgcactctgacggttcgaaagttgagtgatactggattatcaagcgactactgctacgagatggtggactcaggaagtaaggtacagctcacttggggaggaaaatggcacccattctttttgactaacgaggctagtttgataatgctaaactggttagggactgccaccaaaaagcatgctgtgggtaggccttcggatgcgcttaaatccttcagcccgagtaaatttaggccggatctaacgccaaagggggtcgttgaacagatgaggcaagtccggactccaactgagagagcactactgttaaggagaatgggtttcttacctgatgaagtagcagctatggatttagcctttcagtccgttggggatttaacagatatagaggaattggaagatttctcttcatctcccaacttgggagggatgacatctgcctgtacagaacatcttaatgagctcttcgaacatgaactcgtattcaagaatgcggttgacgatggtacatatgtacctggtgataccgacttggtgacgaggaacatccgctccgctctactacaccttctaacggagttgatctatactgagatcaacataacatgcaattacacacctaacatactccagaatctgaagactggaggtgatagctacgtaattgcaaatctaccggaaataacaataaccaaacgtaattagactctaaaggacgaaacacactcggattaataacaatc

SEQ ID NO: 71 - DNA, 1001 bp, Unknown
  derived from dsRNAs of unknown virus
tggtagaacctctattatcaggtatcgtactaggattagttccagtaacaattacaggtttatttgttactgcatatttgcagtatcgtcgtggtgatcaacttaacatttaggttgattttacaattattttaagcattaaggaattaaattttccttaatgctttaatttttactaaaaaaactggtaagttgatttttaaccttattattatgcataatagaatatgcataaataaacaaattagttttattggattaaaaaaaaaataaatatatagatattttctatatatttttattactcaaaaaggagagtttcgctttatgactattgcgattggaaaaactcaagaaaaacgtggcttattcgacgttgttgatgactggttacgtcgtgaccgcttcgtattcgtaggttggtcaggtatgttattattaccttgtgcttacctagcattaggtggctggttaactggtattacatttgttacatcatggtacactcatggtttagcttcttctttcttagaaggttgtaacttcttaactgctgcagtatcaacacctgcaaacagcatgggtcactcattattattattatggggtcctgaagctcaaggtgattttactcgttggtgtcaattaggtggtttatggacatttgttgctttacatggtgcttttgcattaattggctttatgttacgtcaatttgaaattgcacgttcagtaaaaattcgtccatataacgcaattgcgttctcagcgccaatttcagtatttgtatcagttttcttaatttacccattaggtcaatctggttggttcttcgctccaagttttggtgtagcggcaattttccgattcatcttattcttccaaggtttccataactggactttaaacccattccatatgatgggtgtagctggtgttttaggtgcagctttattatgtgctattcatggtgctacagtagagaacactttatttgaaga

SEQ ID NO: 72 - DNA, 1018 bp, Unknown
  derived from dsRNAs of unknown virus
gataagatcaaagcacgaggtgtctgggcctaccccgctgaggttaaagtcatcgaaatgcgatatgttatccctttgatgaaacgattcggatctttattcggtcgtatcccttacccagttggccgtaacatgactaaagcactacctatgttaatagatcatctactcaatgatggtaaatggggctttgtcactgacgttagcaaattggatacaagtataggaccagattggatagactgggctttctcattcctgaaagaaatgttctttatgggtatgacacgttcagcaatcacacgtaatgaaaatgtgtttgagttcctcaaatattatttcaaacgtacccctatcctcttaccttccggtgaactccttcgtaaatacggtggtgtaccttccggttctggtttcacacaaattgttgacacacttgtcaccacgcttctcactatctatgctatgttagtcatgggttatgaagaagaagacatcattgatgagatctttgttgttggtgatgacatggccacatcggttccaaaggatttcgatgttccccacttctgcagaattgtagcaatggcaggctatgaagttaacatcaagaaagtaatgttttcaaacaaagggcttgagctcaagttccttggttactccaagcatggaggtaacatctttcgtcctattgatgaactcctccagaccgctctgtttccagagaagtttgttggtaattcagatcgcgctcgaatgcgtgtaatgggacaaacgatagcttctgggctatgtaacggtttcttttccaagtttaattattggatggccgaacatgccagtctatttccacctgacccaggtgagatctacattccacagaaacggtggattaagaatgttctcggtatcgaggacatacctcaaacgatatgtgtctttgacatatatccgttggtgtagtttcagactcaacagtgtatccatgtttacactctaatcttcacaggataataca

SEQ ID NO: 73 - DNA, 545 bp, Unknown
  derived from dsRNAs of unknown virus
cagacacagcttaacgggaaggcgccgactggtaattatatcacatacaccgatacttctaactcgggaccagtcacaaacttcaagatttacaatcgactgaacacctcacttaccttggctgggtacactgcagactgtcactctttgctgaatggtggtattctgttaagtgactcgaatgattttgaaatttcatcccgttatctctacgcaaaaacgacttttaattactttgaagggtcaagcggtggaacactttgtgcgagcgggagcatatatattcgagttcgcgccggtgattcacgcttattttggggcagcagtgcttatgtgaattcgagcgatgaccggttaaagtttaatgagaccgacattacgaattcgttaccaatcattcgacaattacgaccacagacatatgacaaatcctcagtgctcaacgataacagtaatactgttcgtgaagcaggctatattgcgcaggaggtcgcggaaatcccagaattaaactggtgtgtttcaggcggtgggaccgatgaaga

SEQ ID NO: 74 - DNA, 1682 bp, Unknown
  derived from dsRNAs of unknown virus
gaagttcttgacaggtgaaattaccatccgcctgaatcagcaacacgaggtctacttatgggacgtggaggtgctggagaggcggaggtaattcaggcaagaaagcagtacatgcgtggctttatctcatttgcggcgcctttaaagaagggtggttcgcgtgagttggatccagtgtcagtgctgatgggtaatgtccagaacaagatcttcgacttcagccattacgtagaggatgtccaaaaagcgttcccatactggccactggagaagattatcgcacacctcgagatggtaaccggaacaccatacgccgacgccgaagagtacaaggcgattgaagaaggtaaccacagtggaattgtccgttcacgcgtgcggtcactgacagagtcagccccttcagtgtctgacgcgggcgtcatcatttgggttcaaggatctattaaagatgacaccgtacagccgacacgtaagttaggaccgttagcgacagttgagaagctgaaaatggacgtgcccatggaactggcggagagcgtgacggaatggcacgctaacgcgtggccgggcggcagcccaacgcgcatgctggaggatgtaagggatggaagagaagtgcctcaggtgttttggactaagaatattcatgaggagaagtcggacttcacaatatcgtggcttgccctacaggacatgttagggtccatgaatccactaacgcaatatgtgtacaagatggatggacgtgatcgccattactcagatctactgcggcatgtgacgcagtggttgactgtggctacggctaaggatttttcaaccccgccaggccatctacatgaggcgcgatacgtacacaactggtggcgtcgtccattagccatgtcggtgcgctggcgatcgggaagcacaagatctcaccgctggatgtgcagttctgcaggcagtggagtcatggcttggcgtacacattgggtccacctcaggtggtaccctgtttcgtcatcgagaatgatcggtttgacggtggggtgatcttcggaccgccagcgcgagcgggcgcgccagacatgcagcagtacatcaattacgatccatacgttatgttagtgcccgtactggaacctcaggagcggtactggacgccgcacccaaggggggggtggagaatactcacccaccatgagtggactgggaatacggaccagctacgttttgatgtcgcagaacgcgagtatttccatggagccggttcggttataacatcctggcacgcatcgctgggtgttggcgcgtcggtcggggacacggtcatcagggcgcgcataaaggagaagtacgctggggcggacgtagctggccacataatacacgcacttctagcgcatgaggcccattatctgtgggtactatacgaacttagcctgaatatcctcacgtcacaaagcatatacttgcccacattcgcagagcagcgaccgggcttgtaccacaccatcagcgattatcgcgctggtctagatgcagcggatgaattcgacttacccagctatgcgcgcaagcgtatcgcgtcgtgtcgcttgatgctcacattacttgagcgggtcattggcaatactacgacggtagcgtgtggggagatgagcataattgttggtcacctattaaaggagaaagtc

SEQ ID NO: 75 - DNA, 1607 bp, Unknown
  derived from dsRNAs of unknown virus
  misc_feature (1200)..(1238): n is a, c, g, t or u
tgttattttgtgtgaataaccaacaatagtaaacatgtcgtcattcgataagaaactaggctccattaggagccttaggaaaacaaataaagaaaatatttttgggtggctaagaagcaacccaaaaatacaatacggagccattaatcctttaatgactccgaggcaattgtacagatctaagttaacaaaaaggttcaaggtaaataaacggctaacatgcatgccagcgcatcgcatgatcaaccatgacgttaaaaaatggatgaggcccaccggtggacctatagatatgaccagcctgaatccaaagataatatttcaatgtattagcgaatgggctgacggagagtttgatcaaaccttcccggccgaatggaaagggcttacatacgagcaaatgttaaacagagtacaacacaattacttgaagcccacgcaccctagagaaagatattacatattcgatccaaaatctactgtttcggaaccaactactgataaacggaaaattgatgcgtttatccaatttttgttaaattgcattaagcacaaaggtggagtgacaaagtacatcaacgattgcggaaggcttagaatcgatgctatgggtggcatgaccaactacaatattatgaaagtgttcccgtgtgacctggcatccaagggttgcgcccgcgtgtgcagcttttgcggaatgcccaacatatatagtcggtgtgacatacaaccttcgtcgaaacctagccgtacaaaagctccttggttgccaaagaatgagacatatgatgaccaataccttactgaagagatgggatgggtcaacaaagatggtaaattaacgaacgaagtctccattgcttggagatgccggctgtgctttggagatttgtctctttgcgccagtcgtccggccttcattccgctgttcgagctggtggagcgaatagtaatgcattatgtgggtggactgttagagcagttgaaattggtcaaatacggagatttctttgatgatgctgacgaatcttcaaagcgtaccatattagaccatgacttagccattgtcaagcggatgttgacaaggttgtggaatggtgtggttgtagtcccgaccaatttatcaacagaaaatatgcgaatgctctataagatagcgccgcaactggatgtggtgcgaagtgtgaaaggaaattcagnnnnnnnnnnnnnnnnnnnnnnnnnnnnnnnnnnnnnnngactcatgcgaagtctgatgggcaccaaagttacaaatatatatggttctatggtagaactgagagaccgggaaaccaccaaatacagcggttttgacgattggttaaatccgtcccctgtgaacatatccgaagacaatttccagaaactgaacggaccggctctactgaaattaacgttagacgaaatattgcaacgggctaatcacttcaagggattatattatagtacctatagaaagtggtgagtttaatgaatctagaacactgtgcactaaacatggtgaagacgcgtggttacacgtcaatacaaaaccggatggttttaaaatgtgtgcagcgacttatgaagctttaaattccgacgcc

SEQ ID NO: 76 - DNA, 557 bp, Unknown
  derived from dsRNAs of unknown virus
gacgctcaagctgaagggctccgtgcaccagcagacgggcgcgctggacgagttccagaaggaggacctggaccccaagaaggatgcgcgggtgttgcttttgctgagccgcgacgagtcggcgtcgggcgccaacctgacgacggcgaaccacgccatcttcgtgcacccgctcctgaccacctcgcagtacgagtacgaggcgtcggagacgcaggcgatcggacgcatccgtcgctacgggcagaccaggctcgtgcacgtgtggcggttcctgatcaaggactccatcgacacggaggtgttcaagcagcgcaccgacgccatgacgacggcggcgtgacttaataaagttttttgacgtttcgagtcgcccgcgctctcggagaagagcgtcgaggcgcgcttcggtcgcgatttttgagcgcgacgacgcgagagaagcaagagagggacgacgaccgcgagacgatgtacataccaaggtcgcgtccgttcccacgaggtagtgtgatgtctgttattacgtgatgcgcataccgtttaaaaaaaaaaaa

SEQ ID NO: 77 - DNA, 698 bp, Unknown
  derived from dsRNAs of unknown virus
gataaagaaggggcggcctggtcgccgtcacgcctttacaggggcgtttccggttcttattatggcgctattgccacacaatatgttaatacctatttaacatgaataacaacaaagaggcagtgaaaactgctgagactaccgccagcctagtaggacgactagatgacgaagtttataactatctaggaaagttagttatacttaaaaacaaactcagatacgccgacagaggtaaagaagaaacgttagaagaggaaacggatcttttatatgactcgtgggcatcactatttgtagtttgtgatctattgagccgcatcatagagcgtaatgacaagttactgtatgaactcgagattaacgcactcggttccaagatgcatgagtacacaatgtggtttcctaaatgtaggatgcaaatattgcgtgcgtatcaggaatacagttcttacattacgaacgagacaaatgatattccactcaatctgactccgcttagttgcgagctaatttggataatgagtgatgggatgatggacccgagagggaatccgctgtgattcaatcaatgttgtacgttcgttgtgaaaaaggacgacaatcgtagttagatatacttctacgagagacatctgggattagacccaggagtagcggtcggggactgctgcaagagcccgttgggctcctgcctc

SEQ ID NO: 78 - DNA, 1043 bp, Unknown
  derived from dsRNAs of unknown virus
gaatattctctgcgtaatataacgcgtaattggaatgggatatcacgcagcaagtggtgattatcaccgaaaacctggaatggagcatactgtcaataagaatatgaagacgtctacttcgtcggatggcgatgctgccaaatatggtagcaaacctacaatcccaatgttttacgatcccgaagacttggctcgcggttcatatgggccacacattgataagtaccttggacgtagcccgatcgacggcccgcctgggttcattttccaaaaagttacctactcggcggcggcagcttccggaaagacgaatgtcgctggaatctacaagctatgcccggatcataacggctacatctatcatgatgccgaaactggcaccgagaacttgatcaacgaggatggggctgacgcctccgccgacccgtccacaatgggagaagctaagctagtgtctggcgatcgtattcttggtgcgatcctgcagctggttgatacgcgatcctcggacaatcgcacgggcttcgtaaccgctggacttgtatccaatgatagcgcagtgccggacacttacggacctgagattgctaataatccgagtagcttcgtgactggtagctcgatcagcggaggtcgcacagccgctgccaatggactcaaggcactatccgtcgctagcccgaatctcaacatctactccccgaccattgtagcggttgaggcttcggatctagccccggcttctattggtacgcctcttaacgcgattaacgtctctggcgtatcgccggctgggaactccaaccaaatccgtttcgttttgaatgtatatgcacttgttggcgcaaggcagaaaaccatctcgcactacacgcaacctgacccctcgttcaggatggagtgccttactaagcaattttgcgagcatccagtctcggtcattcactaaatcttatatgtaatatttttccatcacaattaatcgttatacgacacacaatgcagtaagtcaagctgggttcacattaaagagatgaaacatc

SEQ ID NO: 79 - DNA, 609 bp, Unknown
  derived from dsRNAs of unknown virus
gagaaagaatccggtagtcggattctgatgacttaaattctgtattatgaaaaagtatgtaaaagaagcaatcgggtattccgatgcttggcatctcaatgccgaaagactactgatagctggaccgacatcaggtaaatcgactttgatcaccaagtttgcaaaatttggtatcagggataccgatgatattttgtttgataaacagatatttcctgattggcatgcagtcaaccgaaagggtattaatccctcagttgctctgctgattagattcataaaccatggatctaatagtctttggctcacgaacatgtgggcaaaagacttcctcgaaacccttctgtcgtccgacgggacaaataagaaggtaatattcgtgtttcgtgacagcgctgaagaaattcagcaattaatgaagcaaagaggaggtaccgatcgcttctctctgtctcagctgaaaggctgggtcgaggactggcgtgagtattcctcagctgttagtaacaacgtgataaaattgagagagggtcagttcctttccgatgttgtctgccctactaaggatggatggcgcgtcatgtaaaaagtcggagtctttctccgcac

SEQ ID NO: 80 - DNA, 5338 bp, Unknown
  derived from dsRNAs of unknown virus
tggcacgtacagggaaacaaaggcaggctgaaatgcccgcctccgcaacgagtgccacgcacacaagtgaagccgaagtagccaaaggccgtaggggcccaaggcagaccggtgacaacgcgcacccctacgggggagaacggccaaaggccggacaacggggcggaactagaccgccacaagctgctcccacaacgcaccgtggtgagcaacagcgaggaaacaaactaggcaggagggacgatggtggattacaggtcagacccgatggacggacaggaggacagtccggaggaaatcggaagaccggcatcttgatgccggtgggggtcacggctggtggccgtgaccaacgtgagctttcgaacgcaatgcgtgacaagctcagccagattggcaaaccccccagggaggagaagagagacgactgcatcatttgtgggaagaaagttaagccggaagacaaagagatcaacggcaaacccacggttttggcacggttgtcttgggccgggagcgcatgctgcctcgcctgtgccaagcgccatggcgttgacacaggttgccacattgataggacagtggctagggagcttttgcggcgccacccaaccatgcccccactccaaactgctggcaaagacaagccgcacccatatcagaagaccatgaggcatcgcgccctcaaggtcgtccgtgatgtattgcggtcattgcaggtcgatgccaaagttgcctgggtgggtacacctgccgctatggctatgcacaatggtgagcattccatccttggtgccagcacagctgaggtcgaggagctctacgccaaacgcacgaaagcacgcactatgtgcaagtgcaagtcggcgatgctgtgcatccattcgcatactgcgcgagggggaaacctcaacccaacacagcagaaccgggtcgccgattatatcaccggcgggcgatacttatgtgaacaggtgggtgaccctagggtggacatcgacacagttcgggtggcgattgccggaggaaacttcggcaccacgcccccgactgggccacgagtctccatgcagtcactgcccgacgggagccaaattgacgtcgcaggttcaggaaactggacagcccaattcaaccggcggaaccaagtgggaggcacggtgcacgagcccagtatggtgttcgtccccgagcaaccggctggcgccattttgattggtggcaacttcggcgtggaggacttcagcgagatagaagaggtctctgagactgagccgctgctgcccaggatcgccccattaggggtggacgacggcaatagccctgtatacgccacaccaaggagcagcctctccattggtgcgatggctgaccagtttgtcagggagactggtttaggccgcatgcccggtgccggggacgttaaactcagcgccgacgtatgcaacacccaaatcgggtgggccccgaggcctattgcgtatttatacgaaccccctgacccgctcgacatttgtttcttgctgggtagggggcacacggtggtactggttatgcgcaaccagcagagcctaattggggctctgccgtgcatggaggggtattgggaaactgttctcaaggacccaaacgacatctccaaaggcatggtgacaaccacccacatccgcggctgcgagcgctcctacacgcatgagcggccagcctggctattcgagtacgatggttacgcattggactacgaggtgattagccaggcgcggaacatgacggcacgcgactgggggggcgcatacaaacccctcagtgccaacagctggtctgctgatcgatttgcacgtgcaacggctatgcactgcattgagcaggcccagccctacggtgtccaaaagatgcggatggacctcatcctcaagcacggcataatgggattcaagaacaagatagttcatcaggacctagacattgtcgtctacaagttcctaccctggcgtgggagcgtgtgtgaggtggggccttgcccgaaaattctcgcggattctgggctgtctcgtgagacagccaagagccttctgtcgacgagggccaccgagaaccgtaccctagtgtacggtatggaatcaatccaggcctatgacacactacatggtgcttacttctatcatgatatgagcaagaagcatcatatggtgttgcctacctcgctcatatacgcagccgcgaaattcgtggccggcaaaccaagggatgccgcagtccgtgactcagctatgcgggcggtgcgtgaggagggagagaggatgggcttgcccgaagatgtgctcggagacgaacgccttgccgcgtgtgtgaacgttggcttgaccaagtctgtcgacaacgagctgcatatgttggagtcattggacgtccgcgtgaacagccgccccgaggtttggccttggcagctggcattctggacctcctacgtgaccggccacttgagcatcaatgaaaggtatgagaggctcaagaccaacggaccgaagtcaccaacacgacccaaaatgctattcagggcattgctgttgctgtcatcttgggcgatgatagcaatcgtagctggattggtatggtctgaggagcagaccacaacgcgtgctattgccccccacttgggtcaaaggaggctgcttgcagctttcagcccaggcccccaccccggcgtcgtgctgggggaggaagcattcaagcgaggttttggccttgctgggccacacatgtcactgttcctaacagggttggtggcgttgtgggaggccctttgggtgctgcccgtcaaaggagccgtggccttccttagactatattgcgtcaagtgggcgctgcatgcagcccttttgaacatgccattgttagtcgctttggcagctcattatctgtggaaccgctatgcggggaaacagacaactatatccgatgaggtgttgggagtggttgagggcaagtgcgatgagctattctctcagagagaccaagcccgggtggtccgggttgagaggagggttcacaacctctgtgctacggactggaacaggcacgaggttaagaagcagccacgagtgggggctgagttcagccgcccaacggtcgagaggtgcgattgtagggtctcactctggcagtacggcatcgggttgtcgaatgccgtcccaaccaccttccgcccatgccagcacaacgaggagaaagctgttgtgggcagggcaatcatggccacagattggtctcaggacgtgaatgatgacatcagcctatcgatctaccaggatcgcggctgccacgaactgggaccaaacgccaatgtctgggattatgaggaacggtacagcatcaacaagtaccagtcggtctcagattattgggcggtggagatggttgaggtggtgggttcgatggaaacaatgtggtttagacccaagcgcttgggtatcttgccacccgaaggtctgaagcccgtcgacaaggaggagtggcttagcagatttcctggaatgaaggatgtcatacgcgaagccatggacgagctgaatttcttgcgcccccgcaaggcgcgtgctgacgcgttcattaaacaagagaacgcgataacttatacagcacagcaggataagatcgaatcggatgcgcgtctgatccaaggtcgggacccgacggtaaaggggtcgaccggtccgcagacgttagctatacataagtacttccgcaaagcctaccagggcgatgtgcctgtggcctatgggcctggcctgactgcggaaggacttggcgaatggtacacagacgccaaacgacacgtgcttctcctaggagcgaatgccgagcgcgaattgcgtaagcgcactggcattgctcgcagcgtggaccggtatttcatagctgtgggcggccaaacgtacaattttcgagatctgtacgccaacgccccgggagaggtcgtcacccgcgtagggacgctgggtgacgagtccaccgattgtgagcgtgatgcgtccaggtgggacgcacactgccaccccgccatgatggccttcatcgccttcatttatgagcagctcatgcctgatgaaaagacattcatcagtgagatgtacgagcgcgccaccaggaagagaactggcgtcacaaaattacgcgccaagtactctgttgacggcactgttcaatctggagatggtgacaccactggcggcaataccttctgccatttggcaatgaagatgcgatgcctgtatatgataatcaggcacgttctcggcataagcggcctgatcagccatgagctggtcatggcactgccttatagggccattgtcatgggtgacgatgatgccgaggtcagcaccactcagttcatgaaccttataccgaggctcttcgaacgaatgggcactatggcaggccacaagcttgtcactgaagtgcgcacgccatacactttggagttctgctccgggctgttctaccctttcgaggacggctcacatgtgtttgggcccaaggtgggccgcgtgttagcgaagaccttctacagccgaacgtcatacaaccgaacgaaacagctgaggtgggttcgaggtgtttgcaagtctttggaaaaggcatcatcaatggtgcccgtcctgcgcgtcattgtgcggcagctgctgcatttgaccgcagggcacgtgattatccatgataagcagacgatcagacatttcgaaaccgagaacttccatgaggccgacagtgccacgatgcactttgtcgagcagcgttacggcttcacgcaggcacaagtcctgctgttggagaaatggttgattgacaatgtcacagacatcccgtgcgtggttgaacacccaatgctcacgcggatgctggaggttgacacgtaacctcctttctgtggcaagctccgggccggtcacccgtggagcatttgttatcggaagatgacccactgctggcgagggactatcatgtacggtgtgtcgagggagcacatcgggccgtcctgctatgcacctaatgggcatggtcctgcaccggttcgccggtgttaattgctgtcaacagcgaacatccagtgttgccaagtgttgtcccgacgcactcaggcgcacagtgtcgtccctgcgtaaaggtgggcgttattcagcatgatcaagagcagtgtccgtctcggccaagtggcaacgagacgtgtgcggtttgcgtcctcgcgcaaccactgggtcccaattgggatatatcgaagagggttggctcctgcctaagtacctacggggaacaggtcagggagtccccccgcccc

SEQ ID NO: 81 - DNA, 2089 bp, Unknown
  derived from dsRNAs of unknown virus
gagaatcggagcgaggacgctccgtggggtggatcagtacgagaggaatatagggcgaccacgcgcctctcgtgaaatacagaccagtgtagatctttctcaactttaaataacttaaattttacattatgtcatatatgtatcatacagttgtggtttggaatgacgaacagaatactccgttcttagaatcgcagtattcgggcgccaggaattaccgaaagattgttataactcaggcttctgagatacttccgtacgatcctaattatccggtgttgtatttagtttcgaccgctgactggccgaacatagcatcgtggtttagcacagcgggagtcgcttacgaggtaagagctaacacacctcatgaaatcgatttaacggacccagcgaacgtagaagttatagagggcctttccggagcttcgctctccgcatcggccgtagctgttacggcttacgacccgttgagtccggtggcgtatcgagccggcgagctagtttcgatggcagaagacacatccactaacacctacggtattagtgatagtgcgtcgatcgggtggacatcaggtggtcctgaagattggggtgacaaccaaacacatttggttggaaccgacttattcaggattcgcgttgatagcgcaggatcgacccagctcgtacacactgatattagcgatccgatcaatcctgtgactcaggttatttctggaccagatttttctctgttactgaattctcctgattattgcatggcttgtatcggacccgtagtcgacgatcaaggcgtatacagcgatcgtgaattcattgtagcggtatccggctacaacaatggttctaattctggcttctttgccgtaaagtgcctttgggcagggatcttaggtctcggctctacagtagaattcggtaaagtaaccaagaagaagacccttgtgctcgctgtagcgtacgattcgaccgatgacgtgttgcattcagtatacacattcgacgatgatttcatctacaatgacggaaataccaatccatggggaggtaataccttaacgtattcccaaactatgaagggatattctgatattgaaaatggaaacaagcgtgtcggagcgtttactattagattatatcaacctatcaacggtaccacccgtcatattattactggtggttactttgaaagtacgggtgtaattataggcaacttgacttatagagagacggccactatcgcttcgaaagaagagatatcgtttcctatacagacttggagtccaggtactgagttgaacttcggttcgatttgctatcaggagtctcaagatcgttatcacatcgtatttctggcggaagcctttccaatgactatgttttcctacacagccggcggactagtggattcccctcaaatcgatattgtcgacatatccacctctccgattgacgccgtcgcaggcgctgttcaagcaatcgataatgaggtgtttcttgcggcattagacagtgaaaacaatgcttggctcgttaagatcgccgatcaaaatggagatcacgtacaagcagaaatcgcatccgttactgggcaggcacccggaatagcggaagtcgtgtttgaatcgatggccctttatcccgtaagtgaaggggtcgttggagtcagttattcagacgtgaccacagtcgaagcgcttattagtatcatcgatgtctcctctcagctaagtctcgtaagagataagattggagtcatctcatcgaacaaagatagtgcagacccctcaatagcgggagattggcgaatatgtcaccaaggtgaggttgcagccataagaacagacgagattctagatccaactactggattgaatgatcctgtcgtagcaggtcaatctatatactttgacctgtcaacgaaaaagccagtaacggccgcaggtccgaatcgacctcttataggtaaggcggtaagtccctctgctatgttggttttgtaggtccaacgaacattttttgccataaatgagtggtaacactcataaccggtcagtgactggtcccccacgcaagtggggagcgc

SEQ ID NO: 82 - DNA, 2087 bp, Unknown
  derived from dsRNAs of unknown virus
gaatatttttctctcatactttctaacttattaagttttatataaattcttataatgtcgattgcctcggaaactaagaactatgctattgagcttgctgagacggctatgaacgccttttccaagcaggcccgtggcaacctccccgccccgaacggggaggaaggagtcaaggtgtataccgccaagggtggctcggcgattacgctccgatcggatactacttccgctgctgtagtttacgatcccgaggcttctcttcgcaatggtcagctctgctcgactatctatgagcgcgacactaccggcaaatgtaccaaggtgtctaaattagatctcggtagagccacggacgaatttctttctgttggtctcgttagctccgggatgaaggtattcaactcctctggagtcgatgtcatcggcgggactcaaacggccgcggtattgtcggccgttccccgtgatatctctactttgagctccactgacgtcgccaacttctgttctaaccatgagcgtgacatggctagcggggtggtgtctcgtgatgagtcaacgctgacgatggcactgtccaaccacctcggagcgaagatgtgcctcgcgcgctctaacactcttgggaacacggtcacgcgtacctgggatgacgcaattggtgcgcgtcgttccaccgttggccagtccctaggcccggatggtgttggaaaccttgtgctgcctgttcccgaggatggcacccttagcgccgcttttgccgcggacccagctggcacgattgccgccaatccctctttgacgctcatcgacactgacaggcttgatgctgataagaacccgctcactcttgccacatatactgctgatttcttcgggtctttggctttcagctatcatactggcaccactggcctgcagtttcacatgaaggcagtcgctttcgacgcggctgataacgccatcgagatcattgactttgatacgttcgccgtggcacccgttaaccagagctacatgacaaagattcagggcacccttaagagctccacagtgcccattgctcgtgtgtgtgtgttcctggaccgtcagaacattgctgggattactgagactctcattctcggatactcgctattcaaggtgtctgcgtttgaggagtgcgccgatattccggcgagaaacatgcatgtgtgcgtgcttgagggtttgaacgcatccgctacccttaacatcaacacggccgctgtgctctccggcgtacccgatgcaaccaatgtgtttatcagctccgcgtacgacgcgagtgatgcagtcaccattgacaccaatgcggtgaagattttcatgtccgcaatcacgaaggtgctgcctcgagcctacactgtgagtggacatgggatgatggaaaagaccattagtgccatgtacgacagcgatttggttgaactctcgttcaaggctatgtcttttaaagacgtagctgcggcggttaagaaggccgggtcgctggctaagatggctggcaagggtgtagcggatgccgcaccggttgtcgaggaagtcgcttccatgctcgctacattccctggtatgcccgggcggatcgcctccggggtggccgctggggcaaaattgctgcgttgaggggtaggccatttcccaagcgtcgtgcaattcaatgaatacatactgccaggtctgatacatagcgtcatattgggtgagcgtgtgtccgggaaaaactacagacgtgtcggtgatttaatgttcgatattaatatacgtgatgtgtcagcattagtcgcggatgtgctgtccggtagaggtttttcctatgtgtcattgttaagggatgtaaccgttgagggcagatcttgggaaatggctgccacacacgcgatggctgggcaagctggagtatatagcggtgtaattgaagatttcacagccgatggtcgtgtattcttcggccccgttccagccattatcgagaaaagaaaactatatgataacttggtaacaagtatagaaaaaccatatctgtcagtttcccgctgaatttcatggagagaaaatgaaacatc

SEQ ID NO: 83 - DNA, 1161 bp, Unknown
  derived from dsRNAs of unknown virus
gaagtttacctaacgacaagtcctaacaacggaatatccccttgttcgtcggacacagtgtacgtcggaggaccaacggaagggccaatgtctcacgatggggtgttgtccttgcaaggaacgacagaaccaacgctcacgcatgagtctatttcagcgtgcggggcgtcggagtcagtacacgaatgtagtcggcgacatatccgcacagcggcggatgatgacgtaccagagcgacgattcgatcgcgaagagcacgctcgaagcgtcgcgattctggcgttctgcagaacagctgcggacgtcacagggtggcgtctcgtcagacgagcgggcaggaaaaccggatggacactcgtaacgctgttaacgcccattggaaaggtatcggcgcgcatcgcagattgcgtagcgccgacctgggtggcgcgtctggacgagtacgatacgttggaaggtccgcgtgctgatagtgtgaggagcacgttgcggatgaactacttggcaaacctggcggatgtctattttgccgaggcggctgggggcgaagacgacgctacccttccggaacggctcactgacctcacagtgagttcggtctaccttcagcaagcggagctgggatggtcggccgaagacgaccacgatccgaacaaatcgctgtgggatcgtatgtgggaccgtgcgcactggatccagcgcggtacggtcatctttatcgacatgttcaacagccactatttgattgagcgtggaaatgcctccgctgttcagcgtcagagagcgatggtggacagctggcgcacacacatggcgacgctcgccacgtgcgctagacggatcgtggtcattggcatgtgggagttgaaccacccgagcacaccccagacaatcggcgaggccaacctcatctgggagacgaagtgtgcgcggcgcgtcgacccgcatgatttcgcggctacatgccaggagagtcataacgaggctctcgcctttgcgcagaatgacaccggcggagagttgtataaatacatccgtgtgccctcgcgctccgtgtggattatgctcgttggttcgattctacgctgacgttgaccttggaggaggcattgcttccgaaggcacgcgccgtagctgtgaacgaaaggtagagtaaagatc

SEQ ID NO: 84 - DNA, 1424 bp, Unknown
  derived from dsRNAs of unknown virus
gaattatttgtgaaacagcaagagtccaacggaataatataactctaatacttagcggaaatgttcgaactaattcaagatgaggacggcggccagccactcggagttgctaaagatgaaaaagggttgtcgattgacatgaggagtgacttcgacttcgtcgaaggtcataaagtctataaggggctgattacaggtatgaacaacttaattgattgcatcaacaaccctaataagcataccctaaacgtggacgctagacagctacttacgttgctttcacggttacccaaagatgaggatgagcgcgcgctattcacgcgtgagcaactcttaatagacaagagtgagcgaatccgagagcggctagcgatgataacttctattaggaaatctaacgataagctttcgaaggcgagagaacaacgccacgcatccatattgcaagagcaattgacgacggaggacctgcaggtggcccgtaacttgatcgaggaagttggggcagttcgtgagtctttatcggagatatcgctagcacaaatcaagctctcagtggagagcacgcatctcacggctgagcttgatggtgttgaaaaggatatggtcactttaaggaaacagtcatacatatcattattcgatcctacgatgttgcttatgcagcatttcggtgataagctcgatgataagtacgagaatataccccttgatgataaaagaaggatcaagaaggcaattcttggcaaggtcatgacatcgctgcaagcgctttcagctaccaggtctgatacaagcggtgcatcaagagcactcttctataaacattcttctgtattcaaagatactatggaaatggaagtagcgtcctttatggaaacagaggaggcacgaataattcaacaagtgtatgagatggcagtggacctacagaacattcgtgaggaaagacaaatgcaggagcttcgtactactgatacgtatagccttactaaatcggatgttagagtaacgcgcaacccgctaattctagagatgcacatattgaacctcgtgacgcttgctggctacaaccccgaaatgtgggcaaacgcatttggactaaggaccagtggaatcgcgaaacaaatgttaggcttttggggtgatcgtagcactggcccacttacagctgaggacattcgttatgtcttccgcggagatcggaaaccaattgattttggtctcgattatacaagcctcgaattctcggttgaggtcgtgaagaagaaactagttcagtctatgactcctaaatccgaaggaacggagaaaggagagtcattgcctaaattagaggaacgcatgatgaatcccgagggtggtgatgatgcgtaaatcgtaacgagaatcattggccgttaacttttcacaaatgaaacatc

SEQ ID NO: 85 - DNA, 1576 bp, Unknown
  derived from dsRNAs of unknown virus
gaagtctcctaccacgttttgctggttgaaacctaaaatcatgaacgacggaaagatggaggctgacgataatggagccggcgaatcggcattcatgaaggctgacgatctgagcgggatgggtgcaggggcgctgtcgctcacgccgaaggtgtgggataagtatcacaagtggcacggcaacgaccacgcctggacaaccagtgcgatacgtaagcagtacgttatcgaccggagcagcggcgatggcgacgaggtcatgccccaagtgtccgttagcgtgcactcgatcagcttcacgaccttcgcacactttatgcgcatagctgtcctgggtcgcgaacagaccgttcaaggtgtgcggagggaattcttcatggaactgaagaacgcggggaaggaccatgctgcacggctccagctgactgaggccgcttattcgagcgcggtggcgatcctacgcgtcttcatcaacggcggggcggactacagcggtgatagccttgtgcgagtggacgaggcgctattcgaaatagcacgcgcgggggagtcaggtcgaccggccgacttggcgcagtacgtcgaaggcaaggaggttaccgcgagcatgttggcccaacgtcgccgggcaatcgacatggccccgatatggcagacctcgctcaaccagggggcgggcgtcaaagcacgcttcacgttaggcgagtccgatgtggaacatgttggcgctttctacacggggtggacgcccagcgggagaaagcaggacctgaacccggcgaccagccagggtgggacgttcgtgattccgaacgggcgtatagccgatgacctgcacgcggtgttcagtgattacatgagcaaccccatagctgcggacccttcgggtgttacggctgggtcatcagcggaatcgggactgctgggcttcggcacgctgcgcatcggtaatcgcgtcgtgaggctggacgcgcggaactgcgtgctattgcgacctgatggcgactacgtcttgctgtggctgttggcgcccacgattgagccggggatgttcaagaacggagactggttcaagctggtgtctgaacttacgcatgcggtaagcagctatctggcgcactattatcggaacattaccgataaggggtcagaccgcgttgtactgcccgtaacgggcggcgtacacggtgcggctaagttacccgtgaatcctatggcctacctgcggatgatcatgtacatatggctcgtgactaatggaccacggctgaggcgggacctaggcgtcgactggatgaagtcgacggccgagcagtggaccaaggccgaggtgctaatcaatcacaagaaggagttcttcttgttcattaccgccatgaccatctactcgcacataactctatatcggaaagtgccagactggtccgatatttcggagcgctattggcagctgcgtaaccaatcgagtacggatgagttcatgagaaggcttcaacgcgtggcggatgagacgaatatgccggcgatagtcctgacgggctatctgaaagctttagtctaatctggagagttgatc

SEQ ID NO: 86 - DNA, 1471 bp, Unknown
  derived from dsRNAs of unknown virus
gagaaaagaaccggtgaggcacttgtgcctcgagcgtaaaagaccgggttggtgttcgtgcgtaataaccaccatatagtctcccgagggccgtcgggccgcgcgaaaaactcggagggtaattcagggtgaaaaccaatttgtaaatttttaaacacgtattatggattttgatagaatcgaattagtatggaatgaggagggcaactgtctagttggtcgcctcttcaagagtgatgcatgcatcgccgagaaaaagcttaatcagctgatgtcggaagcgatcgcggaacaggtagtttccttattggaaggataatatgaattagccgtcctcagggcggaagctaacatgtagctgtaactatgaaagaaagaaatggataaacgagtccagtcttcagttagcggatcgaagaaagtagatgccgccaatgagtccacacgagctcagacacgtcgtgaaagtttgtcaagaggtataattaattggaacactacagccgaagagcttcttcggatgtttcatggtccaagaattcaacctgcactgggatggaacatcgtgatacacggtttaccaggctcaggcgagtcgactctcctgtctaccatacaagaagagatgggtgcgatagtccaacattctgatccactctatgttgcctgtcgtatgagaaacgaagttgtgaaaggggaccttccattaggaatgaccgtaggtgattacctttgcgggtgcactgaccggtgtaatgaggaagagaatctgaattggtggagcgtacaaccctcgcgtctagaaattagtttcgcaagggacgtatgtcggtcatcttatgcatttaaattcgcacattggctgcgcgggtataaaactaatgatttatcattggcttgggcttccaacaaagttcttaacgttcattgttggcctgcatatgatcaatacctcaaggaggtggaagatcagaccgaactcaaacaatataagccacactcgagagctagataccacggtttgaatgcattccgttcttcagagttcatacctagtaattccgcgggattagtcagatacatgatgcatcaggacagtctcgcagctactattaagactttgtcgtcggattacactcctttggatcgacaaatcgatccatggaggataacgtgattatagttccagtctgaataggtcagactttctcgtttccttataagtagattatgaaatgtctaattgatgttgtattgctgacttgcgttttcacgctgtatgggcatggcatctgcaacgccatagcgtacaacttagatagatcttcgaataatagttccggtatacactccccagtggtgtcggatccttataaaaagacgaagaaccgagagcttttgttttcggaaaaatcggtttaacagaccgataactggtcagagactggtcccctcactaggtgagggagcg

SEQ ID NO: 87 - DNA, 1336 bp, Unknown
  derived from dsRNAs of unknown virus
gtcgattcttttgtcagtatggcttcgtttagcttgcgcgcaccgattgttccagccgatgtcaccgagaccaccggtggcgcggccgacatggcttaccgcgtgacccaacatcatcctgcccccgaacgctcgggagacaatatcactaccgattatcggagtggtatccccttcgggccgatccgttctgcgatcaaggccctggaagagaagacgctccacctccgtggagatgagtacattgccatggttcacaaccgttatggcaacccgcatcacccgacagagcacgccactgccggtgcgatgtccatcctcgctggagaggatgaccatgtgcctctcgcggccattctccctccgacctatgattcgcagggcaagatgaccgccgctccgatgcacatggtctcgacaggtgtcaaccccgcgagcaagcagacgtcgatggtggccctcaccgttgatgacctcttgtctcagtcgggcctcgcctggacggatcaagggagtgtcgagacacgattcctccccatggcaacccttggtcgcctggctgatgagtcaggccgtgaggtaccaactgtcatcaccttgtcaccctcttacacgtttgatgcgtgtttgttgggtactaacgcggggctggctcagaactccgtggagacggacccgggctacgtcaacttggcgcccggtttcgatgaggtccgcatcaacctctacattgtcaaccccgctgatgggttgaacttccgcatccccgagattgagagtggaagtgttgggggcttcgcgacatccgtcgagatccccatggtgctattcatcgacccgctcacaactgtcgatcgggcgaggaaggtcaaggtcgtcaacgagtacatggagagttccatcattccggaccccgaggtcttgcgcgcgaacttgagcgccaatcacactgctgcccagtggttcaaagacttgggcggcaccgatgcggaccccaccgctgattacgacatcagcactgctgatgtcgtcaacggtacgggcccgtatttcttggaggtctctgcctccactgagacgcgctttgctagcacacattatgctcagggcgcgtcgttgggccgtgatacgaggggcaccgtcgtggtgaacttctattacgacccactgctctcggcgaacgtgccagagggcccaggtgggaaggtgttggaccgcctagtcacagttggcgacggaggagcctctccggaaggccaagtggggaagttcggtatgtaggtggtactgctgccaatggacccaaaaccatataatgacattgatctggtgaacc

SEQ ID NO: 88 - DNA, 1338 bp, Unknown
  derived from dsRNAs of unknown virus
cattaaaataaaaatgaaccaaaaaaccaccatcaccaaaaatcaagccaaggctatgcagggtagtcgcccacctgcttataagaaaaaggcgacccaaaaataacaaaccgaagaggtaatgttcaacttcttctctgccggggcgggtaacaacgacgattccgaggtttgcccatccggtaactatgtgacggacaaagacgagtttgtgttcgccactctcaccaagaaaattgctgaggagaaaaaacagcagcaatctgtgacatatgctcagaaggaacatatgaaaaaggtcacagaagagaaacttcgaaaggccgaggctagaaggctaaggagggagaaagccaagtcggagagtggaaagaccgagaatttttcagaggatgccttcgcctctgaaaaacatattaagtcttgcaattcccaaacgcagaacatgcgattgggtactctccacgggcaatatgaaaatgagccaccggagctcactaaactccgatacatgtcaagggtacatggttatctcgctccaatttatattcggggcgcgataaagcacaaaaacaatcccttggcgaaacttttaatggacgagcaagtgttgaatgacctcaacggcaccttgagggaacatatcaagtatgctatgaatcacgtaacatacacgtaaagtttcaccaaggaaatggacgaaaaagaccgaagcgtattcaatccaaagaaagatacggattattggaaagagattgaattcgctttcgaacttttggtcctgaagatcgagggaacattcgtttgctcgttattaaaatcttgttgggctagcaaatttgaagtcgaataagttagacgggttacactgaatttgtcagattatactgctgatgaaatcatgcaatccgataaaattatcgagaaaaaattgagtatgctcgggaaggaggcgatcttttattacccgagtcatataattcccgcggactttgagtggtcgttcaactgtacggtcatgaaaaattagtaaactccgcaagagttgttggatatacaagaattcaacaaaaaatacggatatgctagaccggccgagtatttccaaagattacaagagttagtaatcagcaaaaaggtcggtgttgagaaggtggtggtctccgagctgcaagaaagggcactgtagacgtaccgagggttagacaaggccttatacaaggtgtccaaccgcttgtcaaaggtcccacaaatttagaacaattatgttggtctaaataaggctcaattgagaagcaaggtgaaagagtaggtgtttaaatacgtttactcttcaca

SEQ ID NO: 89 - DNA, 2614 bp, Unknown
  derived from dsRNAs of unknown virus
gaatattgaaagttatattaataaaaacgatagacagacgtagttacgcgcgtatacattaccgtagcgtcattctgaatacagttatcatattaatatgcttgccagaaatcagggcggttttcaacggtcacaacagccgatgcagggaggtgttctacggttacaacagccgatgatccaagagtcggaggtcagtcaaaggacaccaagtaacatcatatttagcgtaccgcagtacgcagtggagtcattggatgagtgcgctattgcgctaagtacggttgttgacgggcaaaagatcccaggaaccaatattgtgttagaagatggtcttgaagccccaggaaacgtacctcttcgtcccatgtcaatagaggagaatggagaagttaaagtagccagctcaggccatagaatggtgacgcgtaacaatccagacttccttaagaatcaagcagctcagcaggcagtcttaaaaagtcaaattgcggatgtgcataacagtgtgtccgaaattagagagacagagcgactcttgttatctgatcctggacagactcagtctggattctaccacatacgatcacgtagtatatggacatgtccgtttctagcaccaggcgtccccagaggtccaacagcctcagtaggaatgcgctcacagggctctgtaacgtgggagttatatcctaatgattacgcgcatggtgggaaagccgaaacaaatgacgtattaagcgaaccacgcggtacgattgattcatggaacagaaatgtggaagtgaactgggtagaggtgcctccggaaaaacctgcagcgatgatgaatgtgaatgttacgatgcccgacaccaacagtagtatattcaacaagcaatatggcaaagatggaggcgacgagttctggcgcttaattggtcagacagaggacaaaccgggccagtggattattgaaagaggacgatataaaaacacgagcagcagagtgtttgtcattactaagaatggtgctaatgaagaggtacccattaaagattgtattctaataaccaaggatgctaaactgttagcaaggcaacatgctcgacataagcaagtccaagcaggtcaatgggtcagagatgtggatgtttcaggcagatacgacatttcaattacctccagggttattggcgcacattcattaggtcatgacattgaccaagtcattccagatgccactaggctaggcaaacgatctctttccgtagtctgtagcttcctgtacaggatcagagatcaggcatggaagtatgtggttaggggagagttaagcggtaataacctggtagtaactaaggtgattacaataatatatctctcactaatcattccaaccatcagatcagcatttaacgtgcatatcgcaccctcggaaaaagaccctagatcatccatagaaataatcccatatagatatgaagagaggagtctaggcgtgataccaaccttccaatatctagagcgattactatcaaaatcagcttatgagggtagaggatggcttggcatgagagtggatgataaaggacccttagcagccgcggcccagccagcgctccagaggatttctatagacattgaagagtttaggggagctactgaacaagtttccgtagaagacatgttaaccctattccgtagactaagtatggaagcaagcagcatgactaacgaaggtataatagaaagcattaatgataaactgtgtgttttcgttggccagggtgggaaagtattccttcccgaggacaaatggaaaatcgcgctcactgattatcatccatcttttgagaaatacccgtattattttacagcagaagatgtcctgcgaaaaatgtactacgcgcggactgcgtatgtcatcgaaaaatcaacagtaactaactcagagcttagagtaacacgagcgcacatgtcaaagattagccgagaagcacttcagacgcccgtttgcataacaaagcgggctggatatctagtgtacaccgctacacccgccattgcaaaccaacttaggggtacggtgatgggtgagcgaatgcaggcgagaggtggcaacagaaacgtggagcctaagttcataggatcagtatactcatatccaaccaagccaaaaggaagttcatctgctggcgactttcgctcatttgagcatgaattcgcggatgagcttggacagcgttttgctctaggcgacatggtccacgacatggcgcacgtgtgtcatactgcttttagagaaaatagcagcatagcgaatacgagcgtaattatgtgcccttcattcgccattataatggtaagaacggaaagtgggacaagggatttcacgtataaagccaacgtaatagttggaccacgcgtatccagactggtagcaagcgactctagcgtgaacatggtgactagaaccgctgagaatgtacttagaaacaaaggatcttacaaaggcagagtgtcatatgctccagcgatgcgacaagccaagcgtaaagatcctaatgtcactatgtattgatagtgttgattaacgaataaagaatataacgccggatttcatgaaaacgtc

SEQ ID NO: 90 - DNA, 1094 bp, Unknown
  derived from dsRNAs of unknown virus
gtaatatttacgagtgaaaatcttgtagtgctataatatcatgtcttcttttgtggtacttgatcctctttctggttcacatgtggcccgtgataggctcagccgtgttgccgatggcagcggcgtagctgttccaatcacggatcatgaaaccgcattttctgctgaaaatttgtctgccttgcctcttagggtgcgtttgatgtttcaggctttgcttgctgctatgaataatgatgttcatgatgagcacggtcgtcagtatcaacgagagggtgaaactaatcttgctcgaattactcctggttcagccggtgcttccggtcaaattgttctttctgataacacgacgagcgccacttccactgaccatacgattattcaagaaggcaaggtgcattgcaaagaaggcgccagtctgagtacttatgaggctagtggatttgctttgattaatttgtcctacgttgacagctcacgtactatgacgctcactgatggtgcggatagcagcactgtaattactcccggtagtgttcgtttcgttgattctactcatgatgctactatcactccggctgtggctgctgccactttggtaatggttggtgactacaacggtacaggtcatgaaactttcaccaatactgccgttgaagctactaatgattggaagatttctgaagaagtgagcagagtgattatcaagggtacgaacactaacttttctttgggtttgacagctgcgcaagccgctactaaccaagatcgtttgatcaccattttcaatttttcccttgaaggttcgactgttgcagctcctctcggtacttggtcatctggcgacgtccttctggatattcccggtgcaacttcgaccggcaatggtaacatctgttccatttcttatatcatttatgactctacgaatggctggcaggtagtcgaccgtgcaatcagcaccgttgttgcttaatttgtgtatcgaaaattttcaagtatcataaagtcgctttttagaattgcttatcacaattactgatttatagcattctccctcacaggcatgtgttgtaggagtatttcaaaacttt

SEQ ID NO: 91 - DNA, 1380 bp, Unknown
  derived from dsRNAs of unknown virus
gaagttctctgtagaaaaccatgtcaatcgtaatctcggaacgtctagacgacgggcagaccgccgtcaggcgtgccattccggtgatactgataggctcgaacgatgatggaggtccggaatcaccgggtaatctcgccgcgcgtatggcgcaggttgcgcttgtcacgggagcgaaggcagtgggagtggtgtcggacgcgttgaacgatgaacgtctggttatctatagcggtatccgcattggcaggacgtccacaccctccgatgacttgctgatgaagcaagcgaaggtcgcggaggacacgggctatgtgcaaggtgcgttgtggaattttgtgtcgaacataaacactgcgtacctcggcaactacgaagcgtcgtcggatgttataccgccccctgtattcgttggtggcatgaatgacatcattgacgcgcacgacatcgtccacggagatggcgggaaaaccacctggaagtctccgggcaattggaatctcagtgaggccatgctcgatgcgctggagtttggtgcagccccgatggcgacaataacggaagccgcgtcattcgttggtacgaaggtgactgttaccgatctgatcgacggtgcgaactacaaggtgacgatagagggcgccggcgagccatactacgtacaacgcgattacgacagagcgatgtacgggatcatagagcctctctctccttcagaccgcgacgagacgtcgctggcggattcggagtcactcgggactgagagcgacgacgagtcttatgaatccgcgttcgaagcgccggcgccgggcggaaccgcgccgggtgtgctcagacggtcggatctgcgcgactttatggcgcgggcggcggagacggatgttgtcgatgttgcaccggtcggccagcccggggcgcagataccgacacgtgcgctgcacgacgagtcgctcttggttcagggtctatcggtaggccaggtgattgccgcgcttcagatggctgaagcgatgaaggtagtagccatgatttacgagggtcaactcccactcgcacgcatacaagcatacgttgaggcatcggacatcgggccgacggagctttatgtagcagtggaccggatccgtgatgcggtcacagacatggaatctacagcgttcgcaaacgacggggcgccaacgcaagcgtcgacgatctttgggatgagtttgtcgatcaagctaacagcgctcttcgggaacgagcagggcccagtagatgtaccaaccttctgggcgcggctgtcggaaaacttcctctcacaggaaatggtgaaggcagcacctgatcgcgatccgtagataggtcgggctagtcgtcggaacatagaagtaaaagatc

SEQ ID NO: 92 - DNA, 2612 bp, Unknown
  derived from dsRNAs of unknown virus
gtcgtttcacgcgctagcgagtagcatcgctatgtccggctcaaaagagtctccggagtcccccccggctcctttgggtggcgagtcatttcccatcggtacgtttgtatccagtgcgatggcccctgcccccccgagtgacagaattccagagacgtcagctctgacttctcgaaccttcactcgtggtgcccttccgtctagtttggttgtgacggtcgaggccctcggcatctcacgcgttgtcacagcgcgagatcgtgatgtcgataatcttcccaacgatcctgaggatcgtcgtgccagtattgctgaaatgctgcgtaagccaatcttggctgctccctccatcgtcaaggtgggcaagctgaatgatgttcagttcatcaactatgaggcgctggagaatgattgggctaagctcgagaccgacaccaccttagcggaggccataggctcccgcgctgcggtgtcgcgacagtcaatcattaacccggttacgaaactgacaaatgccatgatgtacaatgggaggatcaaccacgcgagacatcaagtggcattgcgcaacgcgtttgcgggtgtcgttcgtgcctcggaggtgagagacttcctccaccgcatattgacaacgcgccacgggatgtcactccccgagaccgttgatctgacgggatactatgtgcggctccccccgcctatgtcccccaggtacctgaggcccattttaggcctaggtcccttctccaggtcgcgtttcgcggcgctcggatcgagtttcgtgtcaggcctcattgtgtcttccaccgaaccggatatggggcaaattgacgccgcacggctaggcacgtcccaggcgttggatgccgcccccatcagttcacgtcctgatgttgccatcaagacgggctccactctccttcagatcattgggtctggagggggcattgttccccgtctcccttctggtgtcattcccaaggtgtccttccagcacgccccctactacgttgtagcgtggtttgcgctgtttcccgccattggatcatccaccgagttggcattgatccatattttccttcacgctatgatgaactacgtggagtcagtccgtcgctctggtacggtccccatggtgcggaagacccttcccctctcatctcatggcatgaccatggccaatcttgagatgcacattatttcgccgcggttgctgactttcgtccgcctcatggttcgggcgcgcgccgtcatccacgccacttcgatctcgaatgccgctcccatgtctaccgtggctggggctagggtgttcacgcccatcgagattccggggatggtccctatcccctcgagtgatttctcatccgttgatttcacttctgaatcctggcgaactgcttacgttccccggatcgcatatctgttcaatgagttgagcacgatgatgtcccacgttcagtacatgaccaaaagccccgcatccccgagtgatgcggctcgcgcctggctgaacgtcgctatgaattgggaatatcatctcctccctgagtttgccgcggtactgaccgatcgtccagtcgcggcgccgttcctagttatgcctgggcggaatgagctccatgatgattccctcatctatgctcctattgagcttgacggccccttccaatggatgttgaataatgtccttccggtcgtccataagccccccgacttcgacatgctccacggatcactcgaatctctggggcgcatcgcaagtacgatgcgtaccctccgtcgaggcttcaacccccccatcaacacccggccctcggcatacttcgatgagttcgttcgtctgttgcccgacgcccttggggagtgggtcagtaagattcgggacgcgcgtctggaagcctccttccagaagtcctacgccgccatccctcgattactccccaccgacgttgatccttccgttgccgattccatcctcgatgcaacctacgggtccctccgccgtgatacggcgatgggttgggtgttctttccccagggaatgggcttccatcccttgtcgcagcgacctaccattggtcatgtctctcctgagacactccatttgaatccaatgggtcccggccgccagcctgacattccgagtcttcacatctatgccatgcgatacgcaaatgttacatccgataagaagattcgaactgtgtccacggacgagttcaaactgatgaccccagccgaggtctcagcgcttcaaactccgatattcattcccctgaggtttgatgtcacctatcaacgcgtctccgccccagtgccattccgcgacggtggtagactgtttgatcttgaccatgctccgccgactgtgagattcattcgatattcatcggccgagagacaccgaacttgggtgtcaacccagcttcatgctggagatctgggacccctcgtggttccggtgctcgaggaattggtcccataccgctcgtatgctatgggaccctacctgcagatataccccgtgcccaatgaaaaacggattgtggatctggacgcccttcgcaagatggtgggaacagcataaatcgcgcgtgccttggtgaacc

SEQ ID NO: 93 - DNA, 3426 bp, Unknown
  derived from dsRNAs of unknown virus
gaatattactagataaagaagcaaacaaatgtcaagtgaggaagccgagtacaaaggtccaaaaccgacgcccgcaaaggggcaaaccgtgaaagactttgaaactgaggagcttgggaaaaagaaggaggatggatcaccattctacgaagaattccagacagtggcggaaatacaggcaaagcctgaatatttcaagatcattgttgagcaacctgagttcaagtccatgatcgagatggaaggaacttctgatgccaaagctttaccagacgacagctctagtgatattgaaaagcaacccgctgtgttggaggtatccttagaggaagtctccatgcctgagccagcaatggaagaaccagaagccccaccggcaaaagctgagtcaaaaagtgaattcatcccaattaaacttggattgaatgacccaattggttcattacaactaaaagttgagggtgacatgatcatactagacaaaggtccatatggtgatctcttaaaccagtcaactaatggacgtgactctaaagctgcttacgcatactacacgctactccaaaatttcgctagaccgaaccttactgctccaatcacaagcagtgaaaccggtcgattcaaggcatctaccatgtcgaactactttatggatgagaaggtgtgtggtcgaagcgcgcctaaccatctgtatcaagccgagcaaacggagcctaaatcaattgacttcaccagtgaagttgatcgtgatggaggtcccatcaatgcggaagatcacaggaagaggtttgcgtcgacccctggttacggcacaaaggaaagtggtctaccaagcaaccagttacaggtggttgacttatccttggaaccaaggtatgctttcggtgctaaggacgtgtatggtacaagtcatcatgtgctaacagctccatcgcgcattaggctactgttacgtgatctaagatgctacaattactgggtacttgattggtccagatggacggcggtgcatagtcacatgctaaataccgaattcttacgttacattaaacgtcagaatggaaaagagttaagagatatcctaaccattgataagcatcttgcaactagatacctacgtatctctgatcattgtggatattctgaagacttttaccatctatacatgcctgatgagccagacgcgatatctaagcacgtgttggatgcgtcaatgatggcagctagagcacatgttggtacaatagcgccaggaatgcgttcaattacgactaacagctcacgtgatgctgcatctgccatgacgcaattgagtgcatttggagcaggtgaaggatcgcagtttatgcgtgaattatgcgcattcttacttggaggtcgtcgtcataaactggaagttgagctagacacctctggagcgctatcagaaggcatgaatgctcttgcatcattcgctacactactgctactagatgtaaatttcctaagtgaggaaagtctagtccagctagtatctaacgtacttgtgccgttctacagtaagttacctacgatagatctcgtggctaataagaatctaagtttcagccgtaagattggcaagggaatccctgagatcgtaaagagcattcttgacctaaacgatttcagaatgccaccaatgacgagatacaaagatgtgacgaacaatggacgtactagaattgctatgattcagaatgagctaggtttattgttaaaattcgcacttagtaccacatatcagacgatacggcgtgatagatccctgttcaaaagcaaaggacaagatccattcacgcctttcactggtagggcagacatattcgatattactgtttatggtacagcgtttggtaacgataatgctcgtaacgacacagctaactatgcagcacgtagtgcggacatcgctgagaagcttggtgctatgggaagactactggcagtcctacccgagaataaaggcctagatattgcgatgaggagcgtattcgaaaatacagcatacttaaatgtatctcaagcattagttgcatcaaccatggcgatggcagctcaagatacgagtctcctcgcgtctaagggtgcgattgatactagaagatatgatacaatcaagctgccattgaggggagcgttatcgttcataatgtatggcataagttcaacaatgttcgaatcgaatgtgtcgcaagtgttctactccgatatgattacgccaaagataccatcgaataaagcattctattgctacctcgaacgcgcaatcttaaaatatgtatatgagaagatgatggcgattaaagctgattacattcaatataaacataggccaaaggctctagatcttgtggaagacatactcaaattatacttcacgaaacttgaaccatcgacaagagagagatgccaatacctgttagagactggaaatctattcccaagtagcattggtggagctggttttgataattacgtttttgttccaccggagctaattagtagtgcattcgattcggagacaacaggcataaccgcagacacaattgatgactttaaaggacaccagattgttggacaaccgagactaccatatgatgatgctattgttgacactaatagcgtatataaaaggacgattgaagctgaagacaagcgtgtgcgcacagtttacatccattttgatcaattcgaacctcagcagtacgtagggtataacgacggaagattcttagtgtataatacagatgccgagagtttagaaggcgattttgtgtcattaaaggaccttatggatgatctactatacatgccagatactgtgtcatatgaagaaatcagaacatatggaaagcaatatgctatggacaagcctaatataatcggtgttagaatcgataaggtgtataccacctttgagttcaaagaatatactgatataggcgagttaccaaagatgtcattcacagctaccttggacagaaacaatgaatattcagatttctcaaagttcaatgtttcaccgatcactatatattatcacaggcttacagatcacttcatgcgcaatggctcaaacgaggaagtgaaatatatgcgtaagttaatgccgttcatctcgattccaccaagctctgttaataatacattcgttcattttaaggacgcaaatgtacagagaccaggattatataagagagaaagtgacgggactttggtaatggacgatgagctcggaaatgtaaccatccgtggatggaacggagttacatattcctcacgtttgatgttggcagtgcgcgatgaacaacgcgtttcaattgagtctaacttgatgagacccgttagatagggcaaacattgcaaactgtaaatatctttataagcgaactagtatgtaacatc

SEQ ID NO: 94 - DNA, 2910 bp, Unknown
  derived from dsRNAs of unknown virus
gaatttgaaacccgcacaagaaaaacaatcaatagtaatctaaagaacaactgaacgatataatgaacactttactaacatcgaacaatactttagtaactgataagatgaaacgtaccttacgcagcaactttcccatcggaaaaggcaactacatgaatgttttccacgaggaaccaacagctgacatgctacatgtcacagcaggccagaaacccggcgctgtaatcacttttagtgatgaggcaacagatttcgacgctacacgtctgatgctgttcaatgccaataggttatataaccttaacaagactgacttcgtcaacatgctcaagaagcataattggtcatttgacaaaggtgttgcgtacatacaaatgattgcgcaaacgccagtcatgctcaggcacgaactcgagtctttctatgaggcaattaagggttcacaaaacccaattggatatacattcgttaagagtgtatataggagcaatgaaaacatgtcccaggacgcttttgaagctctggcgcaaatccttccggttgaaatagttcgtgaagtggcaagttttactcaaactcgagctacattcttcgacgacaaagtaaccggttggagtggcagttgggaagcggtttcaaccaatgtttccacattcaaggaatccccaccagttttctggaccaagaatcatgtcccgaagacatcatatccaggaagccgcgagaatgcctggccacgcgtgcacaaaatgtctgtcagcgaaggtgatatacataagtaccatgcgattggtttggattgtttaggacttgagcctgaatcccatagcgttaaattaatgcagagaaacgcctggctctctcgaactcatttaaccttaaatagtggcatgtggctaattaaggatgcgacgtacagcccagtcgctcattcagctaggctacgtgtgcacactcgccaggttagagatgctgtattaaaagcggcgagcgatccacatatcattcatgctcatcccttttccttcaaagccccagactcacgaagtgagcagatcatgctaaaatgctggattgcaactatgttctatggtgacgtactacgaggtgtagacctaattgctaaaattggtgtaccggaaaacgcttcctacatgaacacgcttttagaagcaacggataacattcccggctggcttatgtccgacttggacggtgacaagcgtgtatatgtaggtaagtcagattaccttctaaacgaacatcccaattcaataaatgtgttcgtgctttcagaagagaatcctaccgattccgctatcatgaaagtagtagcattatgcaaagcgagaggcatccgtattattcgtggtatcgacgcctaccttgacgctttgcatactgagaccatctcaggtatagtcatgctcgagaatgatgatgaggccagatctctagcccagggcgtgaatttatcacagtccttgattaggtatgactttataagggagagagttagactgccagacagcgtaccggcaatcatcgtgacaagccagacgacgttcctagctgaaatggtcgtctatgatcaggttacgaatggtcatacattgcatcaacttttagtaagtctgacgctagctcctttgggagacatggctctaacttttcatcatcttaacatagcatctgaacagcattattggatacaaggaacaattcctcaatctcttataggcaaaacggaaatatggatgagcacttatggaaaggctagcgcagtgcctatgtcaatagccggcacctatctatcatcacttctaagggatgggcatgagtacatcaatgatatcagaaagtgcaacccttctatgaatatgttagatgtacgcatgtcagcactcgtatcacgatacgtctatgatgactcagcgctcgtggaagcttccagtagcattaactcctattgtgacaggacctcgaacgcaggatcacacccagacacatggcagcgttcaattgatgtacgtattgctggaatggggaactcccaacatgatgaatattggggtgaccctgctacaggtccaacggagcttatatcatcctggaaaacatcgctgcttcgcagaggagcatggggtgagtcagttccagtgaaaggatgggtggtgcaaaactttggccttactgatcagggtacgtccccaccacagctggttccccctacacaaatgctatataatttaaagatacgagataaatccgtaatcgaattaaagaaggcaatagataaggtacttcaggataggcgagagatcgtatacatcaactactctccatatgtcaatatggaaatggtggaggggaaaaagatgctagaatacgatttcgtgtatgtcaaggttggcatggtcaagggcgttgaaatatacaaggctaggacaccaaccagaaagatgaaacatggctttatcgtagatgatagctcatttttcaatggatattcatcagtatgcactaccttccattcaatgtacacacgtctaagagattataatatacagttaaaaactgatattaatcattcgtctggccatatggccgccgccacccagatgtttccagctcacatcatgcattatctacaggagttacaaagtcaaaccttccgtgtaacggaaggaaaaggtgtttccagtgtttacaacctgcctactgttgaacccagtggcgaaagagttgtctatcattcagttgaagaatataactttactatcgatttgttgcggaatcaaatttctaccgagcctgaacgaccagtggctgatgctgttatcacgctctttagtgaatttgttaccacgctctaattgtaacgggagcgaggtttcaagaaacgtc

SEQ ID NO: 95 - DNA, 1808 bp, Unknown
  derived from dsRNAs of unknown virus
gaataaacacacaacttacaaagtttgtttaattagaacactgaactatacttagatttgtttagcaaacaatgtccactacaagtactgatgcagccggagaagcaccaagcggggatgagacgattaaggtgatggatgataaaagattcccaagggtcagatatcaagacgtgttggcttttgctgacgggtctccaaacgacctttcgctcacttcaaaaagctggattctcaaggccatccttcgaggtgtaaaatatgaaatagctactatgaaaggtttttccgtcaatgtggccctcggatttgatgccccttcccaggtcgatatcgatcagagacaacgtcttagagacgctacaaggcgaagcattcagggtaaagtaagggtagctgcaaatgaactacaggacatagccgccgtaatgcagggtaaacgcaccgagttgaacaatatcttttatgtactaggagtacccgaattatccgtcgcgactataagcgtacaaagcgttgaacaacaaatagattccgacaattggaagtcctctacagggtttggactggccataaccctacttttggcaggtgatactagcgcagctaaggtgttttcgactgacttccttgacacgatcacggtcgtcaagtatgattttgagtcgctcattcccatgttgtataatgcagccatgggctcagctgatagacaaagaatggagcagagccgtcgcaatcttagagattcacttcctgatgcggaggaccagaagatggtccctttaaatgagtttacatccttcggtacgcttccagctaaagcgagagaggtgactgttatagcaaaatcaatcgtaagctccctggatttactaattgataagcttaaggagatagaggagcatctgggacgtttcgatgaaaatttgggatcaagcagcgcccaagatgaggcactcgtgacagccatatcttacacgcttgcccaacttccaggtaccacaacaattccttggcagctagagaacatggagggagggttgaatttctcggatttaattcctctgcccgatgcggagagtattgcatctggaaaccaacccgattccggcattataggatatactgcagagctaatgcaggaaaagtcagaactacgagagctactaactagattcagggatagctttgcacctcatatcacgaagaaagatgacgtcaccaatggcatgataaacgtgtcagctggagatggaccttcggatgaattgcggcttcttcagcaagttgccactctattaaaaggcagcattgaaggagtcattcctataagtagcagaggtattatcacttcaggcgatatcagtaacatgaatgatggtatcattggcatgactgacatttctaaagttaaagaagaggtggaaatcttaaacaactttgtaaaggctaacattcctcccagacgctgggtgacagcttttcggctcccaaccaccggcctgggaaacgcattagttgggctatgggagaaatcaaccgaaggagtgcatgactttagcggatcatatcgccagcctctgtctttccgtgatatctataagcatttttcaacaactggagataatgactctggttttggatattcgcttgctacagtatctatacttgacaaggagaagcgcgaaggattcgttagagacccgcccagtatacagccgtctcctcctctaggaggaaacgtccgaagagggcctagacggggttaaaatgcatcttaaggtgtgacagtgtgtggaaacgtc

SEQ ID NO: 96 - DNA, 1001 bp, Unknown
  derived from dsRNAs of unknown virus
gtaatattgagtggacaatgtccgtcgtaaaaataagtttaggtagcaaattagattctagtcggtcaactttctttgtgaaacgtagtaatgttcttactaaagatggcgtaatgacgttcgatgcaggtctcgaagctcatgtgaaaggaactctgcttactggctccgctactcgtatttctcatacggttgatgatgaagcagctaaagcttttgctttaagtgataaacataggagggatatcttagagaatacggctgcgcaaggcgctatcaccagttctattgaagaaatttcctccggtccatcgctagcagatggcatgtcgaatgcacattctatcgatattgatcctaaggatgtggacagattcgttcaggttcgtacttactctgttgatgataataaatttgttagtgtacaagcaataactgaagaagacgatcatcagactcatcacatgactgcttacttctgtaaaggttacgatataactattagtattgctcatattctcattccgcaaggagccaataaactatttttcacagccgaatttccagacggtggtacaacgagtacagttggtattggtttacaaattgtgtttgctgaaagtaaagcagattttgcggatgtgattggtaaatgggcagatgaggttgatgaagaagatgatgagagagataagagagcagtttctgacagccgtacgatcgcaggggtgcgccggaaccgatcttctgaaccttatgaacaggggagacgtacttccacacgtgcccagtatttatcagagttagctcgatcttcttcctctgtcggtggagcggggggtggactcagttcagatggacctgcttccaacccaggtagaacacgtaggccaataactttttaactagtttcttttaggttactgttgatttcatttacgatttaacgttgagtgtgtcagaagtgatgcatataccaattcactcatgatccaaacttt

SEQ ID NO: 97 - DNA, 2116 bp, Unknown
  derived from dsRNAs of unknown virus
gaataaaatactttgttcgaaactgttctcgatttcaaatctataatttaaaacgatgagtgttgcggcgaggactaaggtctacgccacggaagtcgctaagactgcgcttaacgcgttcgagaagcaggcgcgcggcaatctcaaagcgccgaatggtgacgagaacgtgcgcgtctacaccgcccgtggtggatctgcggtgacgcttaaaaacgcgactacgtccgcggcgatcgtctacgatcctgaagcctcgcttaggaatggtcagcttgctgttcatgtttacgaacgcaacgccgctggcgatgtatcggacgttaaacgtgtgacgctgggacgtgctactgaagagttcctttcagcgggtgtgcttagctccggtctgaaggcgttcaactcttccggagtggatgtcattggtggcactcagtcggctgctgtgctgacctcggtaccccgcgatatcggaaccatcacgaccaccgaacttgccaatttctgcagcaaccacgagcgtgacttggcttctggtgttgtttcgcgtgaggatggcacgctgaccatgaccatgaccgagcactttgggaagaaaatggcgctcactcgctcgaacacgcagggcaatgttgtgtcccgcacctgggatgatggcattggctcccgtcgcaccacggtggggtccacgctttcattcactgagaacaccgacgtcggttctaacctttctcccgctttcacgtccgggcaagccgggcttactgatatcacgactattctgggggatgacacgctgctgattgttgactccagccggcttgacgaggataagaacccgctcactcttgcatgctaccaagcgtccgtggacgtttacatgcagattcagagcccccagctgagcggtggcgctggtacaaccgacagtgatcagttcttgcagttcaagatctttgcactcgatgcggctgataacgtcattgctgagcgccaggtgaaccgcagggctgagcttaaccataacaacagcctctctgtcactttgaacggtacggttactagcacgacgaacccaatcgcccgggttgttgtggcggctatttcgatgagtggtgatctcacgactctgacgctgaacgctggtcaaacttctactgtgcttagggcttacgaagagacggctgacatcgctgctcgacctgtgcacgtgtgcgtgtttgagggcctgaactccggcgcaactctgaacattggttctactgctgtgctcaccggagtgccagattcggcgaatgtgttcatcgccgccgccaatgctgaagaggacgaggtgtatgacagcaattctgtgtacatgttcctgaaatcgatgtctcgtgtacttcctcgggcctttacccttggcggtcatggagtggttgagaagaagatgtccgcaatgtacggcgacgatactgtgacgatcgcgttcaaggcaatgtccttctccgatgtggcctccgctgccaagaagatcggtgaggcagccaaagcgactgccgctgaagcgcttgagctgatgaagtacgctggccctgtcatgtctaccgttggtgacgtggcgtccatggcgccgggtcgtgttggccaggccggtatgctgctttcagacatcggtcacagaatcgcctgaggtgtaggccatttcccgagcatcgtgactataaatggagttaatcatgcagggttattgcataaaataatactaaatgatgagctgcctgatcacgtgtacactttacgttcgggtgtattagtggatgtaaatctaacagaggttggtgatgcgctactttcatatctccgggacatgtcagtttctcgtgtcacgctgatgagggatatcaaaatggagggtaggtcttgggaaatggcttcagttgctgcgacacttggattagatggtactttctcaggaaccgtagagagctacgcacctgggaagcagataatctttggcccagtgcctggcgtacacataaagaagacaatagatgaagatttaataacagttaacgagctgccatttgtgacgctttcccggtgatacatatatgggagtatttgaaacatc

SEQ ID NO: 98 - DNA, 1458 bp, Unknown
  derived from dsRNAs of unknown virus
gggggggctttattttttagtgccgaaagtatgaaacaaagtactaagatataatttcttttccactcattcattcttgcatgaccatgttgatgtagtttgctctaacctcatgaggtgttgagtcttcgtagccttgatggtgttcaacgttccaagagtgtcttccgatttgaagagctgaaccgatttgtacatcgatatctctcagtctgaacgcagatcttgcctacctgtgctgttgttgttcaaccaattagcatggcattccttggtctgaaaacttgattggaaccaaattctcatggaattcccgatactatcggtatccttcaatagcgttggatgcttctgcgtaaacgtcattgaccgtgactgggtttccagccgcatcaagcattgctatgaagttgcactgttgaagcatattggcgtctagttcaaattttgtggtgcacactttgatcctttccgactcagtaagttagagtaggttgacaggagctcgtgcaatttgatcgccagtaaacacattggtgagcagaccattgagtcgctaccgttaatcataggtgaagtcgaaatactacttcctgttgcggtaaacatctatgaattcctattcattgacgtaaccttgaaagtttgcttagtagatcgcactatgaactgcgtttatgcccgcgtagttgatgcatcttccttcatcacaatcaaaatctccatagattgaagaaagcttgttcagtgatggggggactttgagcgtcttcgcttggtccaagattctcatcatctacacatattgtgctttgtcgctaagactattgaagatttgaagaccaataatgaccttagtcaatcgcgtaactgcagctagatattgaggaggcggttgctagtgaatcacgtccacgtggcgcatcgcgtctcgtccaactccaacttctacgctggtgatgccttattagttaagactgtaaactcctactacattgtggggggtgagaacagaaacagaagaggctataatagccggttcaataacagttgttgttttgctttactatttcggtttaccgatggcttacgtcttattgagcacctttttattggtaccaaagattttgtctcgattgaagtgagccgatgtatgggaagctgcagcaacatttgggttgaatccatcttgattcatgtctggcagcacatcgcctaactcgtcagcaattcgtcgctaatccttttgctcgaactaacgttgctttcgagtcattttagccctaagagggttaaattactcatcataatccttcgtctttgctgaatctttccgaacgggagctggtgtgaactagcccttatcgtaaggttttcgattcttttgttattaattcattgatatgaaataatcttcgactggtgtttgaaactaatcggtgatattaatttaaaatt

SEQ ID NO: 99 - DNA, 1726 bp, Unknown
  derived from dsRNAs of unknown virus
gaataagtttcctttcatatccttgagtcatgagtgccccctacaattcaatatataaggacatcagtaacactgcatccataacacctgatgatttagaaggtatagtgcgcttcggtgagacatcatactaccagcatgccagcataatatatgtggaaaagctattcacaaataactcaaacagagcaaagtttcttgactttattactgcaactctaggtagtaattcaattagtggcgattcttcaacgaaagaggcaaaaagttttgtgctagcctgctactttctttacacacttctttacttagtacatcatcaaaattacgatggcatgaagagggacaatctagccctaaacattgctttcagccaatgctggtacaataccatggatgatatctcaaacttccaaaatatcattccagggaagcgtaaaggtaaggcaaacagtagctggtataatgttacaaccatagtgtgtacgcttatgcaatcagctttattccaagattataccgcagctttggtaagtcgaatgtctgacgaattcttctactcgaatatgaacttgactgagctaatgaggcgtaacgccgcagataatgaatcggaaacaacggtaccagtcggcatggactatgtgccctacgaccttttcctcggtggtgagctaagaatcgaagaactaataagcatgctgaatctagaagaggaatatgcgtgctatcctgtgtatgtacaatccactgaacccgcaacgctaaactcatcagtcaaaggccttgccccgctctcgaacccaaatgatgaagtgctatatggccgtacagtcattttacaaatggagaatcccagaactattggatcaaactcgattaagtttgatggtatcgattgcgttagaagacaagtaatggaatactcaccgctctcaaatcgaggccaggaagtcagagtaatgcatgcgataggcttcagagtcatcgagaacatgaaccctaacgaagcctcctcatatgccaatgtagtcacaatgcaagttgataacttggctccacagccagcaatagtcatgaagattgaacagtctagacgagacgttagtgactatactataatatgcggtgatatcaacgatctgctaaatatgtgtagttacgcgcttgttgacagagtgcgcagcttttctttccaaaatcgctcgcctttagaaccagttcctaaattagcgcatggtctcggaaacaaatttccgttaaacgtgagagccttaatgcaagagttgtcacgcatattgcgcacgattagaccttctgtagaatactcaagtgcagctggtggaggtttggcgggaaagatggacgacaccactgctacattatggttcatgttggtaacaatgacggatcatttagttgtcttccatcccgcccttgacgattataatcggggaaaggtacttaacgactatgctaaggccagcagaagcgaaacgctgctgactgtcagagctagaattcgagagctcgccagtaacagcggcatacttaacgagtttgttcaagcaaatcaggccaaatcagttaagaattggatatgcgttacaatacctttaatattggagaaacatggggtcatgaatgacacaaggctaggcaacattgacaacgtcgactgaacctacaaggaatgaggcttatcaccaaagaaactgaaaacgtc

SEQ ID NO: 100 - DNA, 1765 bp, Unknown
  derived from dsRNAs of unknown virus
gaaataaaaaacgctcgaaggttagttccgttcattgtttactatgaatcgttttaacagagcgaattttagatcttctgattcttcttccacgcgcaaacctcggagttctcaagcgtcggcccatctggctcaaagtgttttcatggtatcgagtggtcttacctcttttgaatcggaccgtgatgtcctgaagttcatgcttcctcacatcactgccggttgtgaggtgcatctcaatcctcgctataagctcgctttcatttccaatgggaaaaattatgaatgtaatgtcggacccaggatggctaatgtgttcctgaatcctggggacaagctcttgtcttggcgtggcgatgactctggcttcaatgctcagtctctctcgaaagtcatcgatcccggggctaacccgaagctcaaagttaaccatcaggtgagaatttctcgatctgacgcccgccgaacctggctcaatctacgaagcggttctaccccgtatgacttttctctctccctggccaagtcttcccttgggagtctgagtgagatcctgaattcgccttttcaccttgagatgcgattccctgagtatcagacgctgattaagggaattgctcgagagactgaataccagttcaacagcattgtgtttcttcctaacactgtccgagccgaacaagttaaaagcatgaatgaccagaagggatactcaaaatctctctttgtcttcgccaagctcagcgccaaaatcaaaccccacgctcccaccacctctgtgtggtttgttgagctcgatggtggaaagtgtcaactctgccactacaaggatggtaatctcttccagctggttgatgccattcacatgaagaagttcggtttgggcgtggtgccactgaataacacttttgtgttcatcgacctggcccagggcaccggcgtctacagacagctccccgatgttcaaacgcggtcgatcaatcgagaaatcgtggtttccagttcggccgttcccgcacgggcaagagtgaatttgggtaatggttctgccagtgactcgaaagttcatactggtgggcgtggcggccccggccagcgccctcaacgcggacgtggaaatggaaaaggcggacatggtcgtgctcccactcctcttccttcgcgctgggcagctcaggatcagagagatgatgccgacaaagaagcagtcatacgagccctgctcgggaccgaacaggaactatcgtctgctattcttgccgaatctttgaaatcctcagatgaggaagatgctcaggatcctcccttgcccgaaatccgggagcgtaaatataccgtcaacactcgaggtgagctgactatcctgtccaaagttcatctgggtcaggataaaaacaacaatgtcgtcttcgggctgatcaccagtcctgatggagaaactgaagaggcctatcttttgaaaatccatgagaccgaccaggggcccatgtactcggccgctctctatgaagaagaccctgaatctgtgtcttggtccaaacattacaatgaattcgttatcggacccaacactgctgctggccaagacgacattcctattaccctcgaccagattcagaccgtcgctgacaagacaaccttcgatggatacaagcctggctaagaatcagacctcccatcctccttctggctcttaagatcaaagcgtgcacccgttttggacttgagagactaggggcgtggggggacttatcaactcaaactt

SEQ ID NO: 101 - DNA, 933 bp, Unknown
  derived from dsRNAs of unknown virus
gggatttttttgttatcgagatggctcttccagcgcctggattatcgcgtaccacactagtttatgcacgatgtgatcaaaatgtttatcgattcggacgatcgatcgattactatgcccgggaattcatcaagattaacagtctgccaaatcgcaattcagctgcgatacggacagctagctacaacctcacaaatgaaacgctcacgcttgctaacagaaagttgtcttcagctccattgaacatattaacacaggtcattgctgctgtcgtcagtgccaatgccggagcatttgatcatgctctcatgttatcctacatcaaaggggctttcgctcaaatgccataccctgatgctatttctgcaatcaaaggaacggcaggtgactttgtgagtgcaaatcctctgtttttctatggcaatgatggagaaatatactttgaaggcaatattggcaaccaagtagtgatttcagccactatgaagtcaaatgagaatttctgggtgtcatcagagagaggcaacatcacactgaatggaggtggcactgctgcggtagactttaacatgtcagttcctttcactgttagattgaaccccggtcctgtcaagatcaagataatcgcacagtgctatctaccttttgatgctgacctacttgatgatgctcgactaggttacaacagatttaggaaatatgctgtgcagtcacttggtggacagttttatttaccaatcagtcttgacactttgatcattgcatcatacaaggaaaatgcgtatcaatcacatgtgccggcgatccttgtatctcttttctcagcgtacgagatgttatccagatgctactgagctcagacggtctggggtgtgctatgggaactcctcacgttcccataccggactgactgtcgttaaacaaaaacagacc

SEQ ID NO: 102 - DNA, 1456 bp, Unknown
  derived from dsRNAs of unknown virus
ggttaataaagccacccttttaaaattttccataaataattttattagaattcaaaaatcatttggacaatagaaaagtgttgtacaatgtgaggtgtacttattaccaagaatttattcttaactttagagcagtttaatcaactatctattcatatcataacatatgaattgtgccttgagaacggattaatcttaggatttagttaacacgtctccagcggttaattgtttttgccatcggaatcctgtttgcttagattgttgcatttgtcaatcttaatcggttgttgtaaaatgtaaatggatgataaatagtatcattaaactattaagttgtatctacaacattaagaaaaaactaacatgaattttagactttcatttgagcaaggtaaaaatttaatatctaaggacttagttcttattgttgagcctagctattcatttgtcaagcttttaccgttctttatggaacgattcagattacattcgagcgctcgtattgatgcatttgactttaaatcaatattttacttactactatacgtaagattgatcggtcctcagaaccaacacctaagtcaaattgtttataactatttacatactattcaaatccctcgtggattacagaaaataattcatttcatgcctctgtatggattatcgtttaattataagaaccatgttctcacttttaagcttagtcaatctcttgttgatgaaatagaagctggaattaaagatcattcttattttgctggggcttctaacctctctagacatctggttggtaataaaaattcacttagtgaaaagttcaatgaacatctcatgttttctatgtctcaaacatttcaagtgagtagttatattgccgttagcgataataaccaaaggctttcggaccagtcgagtttagcactacggtgtgggactagctcccctgacttcaatattggcatagcattgtcttttgttttctgtctatcggctaaggattgccaagaattagatagactgcttggtattacatggtcatgtgaaatgtcaaatctttcatttgagttaaatgttagaaaagcttttgctggcctattgtcaggcattgataatgagccgaagccttcaaaacctaagggagtgagttctgaacactccattcccgatattagtagtttttcgaaaagtacaagcgataattcattcttaaataatcgtaatttaatgaaagttgttatgaacagagataacaaagctctgacaaacattgtagcgtcagtagtccttgaaactttgagggttatgcgtctgaacggggaacttagcaacgatcttgtgcgtgcttaattcaaatctggtgagcgcacagtttgttattatttaatgtacgactgcaaacaggtaagatcctcagacaaacactggagtggaatcctaagatctcccctcc

SEQ ID NO: 103 - DNA, 1027 bp, Unknown
  derived from dsRNAs of unknown virus
gaataagttttatagttatattatataatgagtgagtattccgcaaaaagcgttctagataagggtaccataccccccgttgatagtaacgacgtccttggcggatcctttggagctcatattgatcaatatttaaacaaacaaccttttgatggtcctgatggatatgtctttagaaagatatcctaccgtgcagcaactaaaaacaccggtttggcagatgctggtggtacaatggcaaccacagctggagaagttttaatgacattcaagatggatgagctatgtagaggaatgattgatgcaacatccttcactggctctaccgctaatgatagaactacaacgtatatcaatgatgatcaagatcaggaatcaaataacttggaaaacgcggtaactatcactaatgaggctaaacttcaaagaggagatattcctcttggcgctatcctcgttcttgaagatgctagatcaactgataatcaaaatggatccgttttcgctggaatggttccagtcgacaataacgaccataagtttagtactgacaattcaagcaaatatggcgtctttccatcggcaacctcgggcgtaccacacataatttcacagagtatatctaaacactacattggtggcgctgctaagacaaaacgtctagcagttgcaagcagagccttcaacacagcgatcccagtacgcttcactgacgagacggctggcaaggtggttgatagcgctttttccgccaccttcggtggcgacatctcaactccagttcactgtattggactaagtggaataacgttagatgattgcgataacatttttggaaatctacacatctatgcactatgtgggccccgcactaccggtttgtctcaacctgagattgattacaatttctcggttaaagagtgcctaaagctaggcgctagtagcggtcatgtacattacgaaacataaatataacacgctatcaccatgtcaacggtgggttcaatagctagagactgaaaacgtc

SEQ ID NO: 104 - DNA, 1827 bp, Unknown
  derived from dsRNAs of unknown virus
ggaaataaagagtgaaataaatcttttatttcttgtaaactcaaaactcgttaagttttgtgaattcctaataaataaccgttcttacacagcggtaggaatctcctaactctaggaacatctcctgcggactctcgtattgtgtattgctctcatgccatcgctctcgaatcccctatttaattttagttttctgaatccattttcacggaccaggatcctctcaagctcgcttcatgcccatccgctcagccgaccctctcgccatggctatccagattccagcctatcttgccgacaatgttgtagacaccttcgatgaagacctaccacttgtacttgttgcagttgaaacctacaccgatcagcacatcatggaagaagctcatatgttgcagcaaagcttcaacacccgtggcttttccaagccactcgaaccagttgagacagcattgtttccgcgactcggagagtttactgcccgccgttcctttggcgctcgcaatcagcgttcactttatgtgaaacgcgctggtttcaacgcgctcaccattggagctcacgcccctgcccatcctcagtatcgagtcaactcgaacattgagatgccgttttgggatgcaccccgccttgctggcattggttacaacgagaaccacagccttcgcattcgcgaagcactcgtcctcgaccatgccaactcagcagcacccacggtcgcatacatgcaccaggagcacgaaaagacaatcagttcgctctacaagaagcttggtgtgccaacctttctgtatgcgcgggacaactccgtcatggcgtcgtccaactattacaagacgcttgtttcggttccattgccagtcaacggtggaggagcttttcctccccttcctgcagtgcatccgcagccaggcctcttggctattacgcgcgatatccacgcacagacacagaatgtctatgcttgcaaggatcttcctactacattccaagatcatgctatcgccgccatctttcgcactcagacacgcactgacaaccgtcagccgccccactatgaatggattctctttggtcccgacaacggagcaaacagagccttgacagtggcacagaatgcaattgatggatatcaaattggaggagttgcaactattgcagccaactcagtgattcctgtcaccagtgcactcacactcttgcagcaccgggtccgcccccgccagctcgttcttcaagaagtgtcaatcgcagagatggccaatcttgttctcctccacaccggttcagccgatgcgacgatgccaccacctggtatctcgctcagacaaaatagttttgtttcctcgtttatttattaccgaaagtttagatgcgaggggttgaaattaacccaccgtacacaagtttggttaaggtatgacgaatcagactcctgctcgcccagcagtgccagtcagtgagacgccggccacgcggccacgctctcgctcgccacctcgctagactgtttgcagctctttgcgctccagctcgcttgaaagagtgtatccacacagcctcccaccaccaactagctatccagtgtacaaccaacaaccacacaccttattattcaatacaacgttatcttttacagacggtgtcttccgttctttaatgactaacctcattcactcactataaacaccgattactgacatcttaaatatgcattttgccaacgcacttgaatcgactctccacgtctcgaattcgacgcacccgaagacaatcgcctccggcgatcgaccccaccacacccacgacccccaccccaggagatag

SEQ ID NO: 105 - DNA, 807 bp, Unknown
  derived from dsRNAs of unknown virus
gtaatattctctgattcataacggtcaaattcgagattggtattcttgaattatgtccggcctaggcgaggaaagtctggaaatgcgtgtggtaacatacgtccaactattccttggttttataagtttcttattgttaacatttttacttcgaatcgtagtcaataaagtaacggaagtgcttcaagttggcatgcgcgctcaacttactgaagtcagaaaggtgatttttgaaacaaatactggagctaagtcgctggaattgaagaaattcgccttaaaattcgttgatgatcatggtcgtagacctacaaagaaggattgtaagatggctggttttgaagcgaaacgtgacgtaaaagacattcgtgagtttgcaacaaaatataagaaagatctttctgatcgtggcgttgaaattaacattccatggactatgcgcgaatatgatgaagtaactgaccgtcaggttcaaaatgaaaaagacaaaggattggtgattgatttccttaatggaaatccaactatcgctagtgagttacgtctatcagcactgagtaaaattggtcctgtcaggatctatcaaaacaaaggcgtttttaaagcgttttgtagtgaacatattgctgttgaaatgagtgaatctgaaaccgaaatgacggatgacgaagaagaaaaacatgtacacgagggaccgaagcctgaggtaagtttttaggtggctcgacgttggggtggtttccaattgagagaaggtgcacttaaatatgaataactgttaaaacccagtggagatttcaaaacttt

SEQ ID NO: 106 - DNA, 1341 bp, Unknown
  derived from dsRNAs of unknown virus
gggggggttgtattagtttgaaaataactgtactaaacatcaatcatgaaataaataagtagataaaatcaatactatactaaacataatcaatccgttcctgtcttctcactttcagaattggtttataaccttattccgagtgatggcgtgttcgtcgctgagtgtgtacttgtagggaaagaagttgagttctttcgttctggtgagtcttcctccttggtggagatcactgtctgatggaagaaataccatatccagtacatgcttcttctgcttgaggatcgcttgtcctgctgaacctgtgccacttgcgtcaaatttctgtctatatctgacaaatctgcgcagttgttgttgttggatgacgtctctggcattcgtgtatgccacgtgaaccatctagactagtttcttccttgacagcggactaacttaaagattgatcaattgtagaatggtctaatctttgttgttgatgtagtcgttgtatgctgcctagatctatgctaacctaggaattggtattccgttgttgaaatgaattgccatcaattatacaatcgcggctccatttcggaatccctagaacatcgtatcaacatctcgcattgaaatggtgatagtgcgtgaaattgagttcactaagtcgtcgaaatgtactcgcaaataattttgcactgctatttagccgaaactgtcgtttgatctgagatacgtatgattcggtgcgttggcttgaatagcttagatattagctatctatgcttgatcttgctttcgtatgaaatcatcataatctagtgctaaggctagtagcacactaagtctcccaatgatgagttccactagaacgtcgtcgtcaaaggctttgactttaccaaatttgcactcgaagtcgccatagaaatggattacttcatgaacaatctttggaagaaggggttagacactcaaaagtggaccaatattttgggccgagttagcttgtgcagaattcgaagacttgacaacctactataaaagagcgacgagaatgtcacacttcattagatctctggtttgttagtcaggaatcttacttgctagttgctcaatatcctgaattaacttatgctcattttaatatattgagccagaatattcagggtttacgtcagaaacaggatatgaagtcactgttcccaagtcacttacgtcgaaatcgtactctctatggactgtgatagtctacggagtatccaggtgtgcggcgtgtgctgtaaacattaagcttatcaatctgtaaaagtttgatcttcaatcggtatttgaaactaattggtttattgatttaaaatt

SEQ ID NO: 107 - DNA, 2092 bp, Unknown
  derived from dsRNAs of unknown virus
gaatataatactgattgaatcaaaatacaatattaagaacatacaaaatctatttactttaaaatgtcgattgttgagcaaacgcgttcctacgcagtagatctagctgactcactgcttaatggcttcacgaagcaagttaaaggctctctacaggcgccaaatggtgatgagaacgttaaggttttcactgcgaagggtggttcggcggtaacattgcgaaacgacaccacatccgctgccgttattttcgatcccgaagccacgctaaggaatggacaaatgagtgtgtctgtgttcgaacgtgatagctccgacgctgtgattaaggcctctagagttaacatcgggcgctcgactgaggaattcatctcagctggagtgctcagctctggcatcaaggtattcaactcgtctggagttgatgtcattggaggaacgcaaacggccgctgtgcttacgtcagtgccaagggagatctccactatcacctctacggacgttgctaacttctgtgcaaaccatgaacgtgatcttgcgagcgggattgtttctagagatgacgcgactatgacgatggttatgactgaccattttggtaagaagatgtgccttgctaggaccaacacccattctaacttgattaagcgagtctgggacgatggtatcggagataggcgaaacacgattggtgaatcgcttggcaagaccgccgcgacgaccaacatgggcggagccggtacatctcttcgttccgaggcgactctgattgcggacaccgcacgtactgtgctggatacgtccgtactgactgacgcgaacaacccgctaaccctggcgacgtacatggttgatttcgacgtatacgctacgtttgaatccccgacgacgactgacactgacttcacggtagactttgctgctttcgcacttgacgccgctggcgcggtggtcgggagacgcgacatgcatgatgttaaagccattacgagtggagcgcaattgcaactgtcatgcggcggaactatcacgagttcgacggttccgatttcacgcgtaatcgtagtgattgatcggactctggttgatcaatctacgttgaactacactcccacgaggtccaccaacgtggtggcggcgtatgaggagacggctgacatcgctgctcgtccaatccacgtctgtgtacttgaaggtctaaatgcgtcagccacgattaaccttaacacctttgcagtgctgaccggtgtgccggattctactaatgtgtttatttcttcgtccagcccatcggatagtgaaatctatgacacaaactctgtcgaaatcttcctgcgatcgatttcacgtgcacttcctcgcgcgtttacagtgagtgggcatgctgcagtgacgaagcacctaaccgctatgtatggatcggaggaagtttctatcgcctttcaggcaatgtcctttgagtcagttgcaaagcatgcgcagaagcttcgtagtgttgcgcataaagctggaaaggaactggcagacgccatggatgcgttggaacctatcgtatcaacctcagggaagatcatgtcgatgttgcccgggccggttggaacggcggggtccttgatgtcgcgcggagctaacgcttacaataatatgaggtcctgaaaaacagcacatttcccaagcatcgtaatgattaacggagatatattaccaggtaagatccatacattgataatgtctgataagcagcttaaaagaaattaccgtttcgcacgtggtatatacgtcgatacaaatctacgaaacacgtcacctcacgtattacaattcatatacgataatggatatagctacgtaagcttgctcaatgacgttattgttgagggtcgatcttgggagatgtctgcagtgaaaagtataattgataagcctggaatttattctggaacggtggaatctatatcgaatgggattgcaaattacgggacggtgccaggattagctataaagaagaggatgaatgtacaattaaaaacgtatgaagattcaaaatatgatctacttccccggtaggcatataaaaagtatttgaaacatc

SEQ ID NO: 108 - DNA, 1679 bp, Unknown
  derived from dsRNAs of unknown virus
gggatttttcgatttgctgaagcatcatcggtgatgactaatttcgtgggtcttttccaaagtcaatgtgcattgaagaaaattaatcataagatctctttcgagcaggtgactacaggatttagggccactctatcctttaacggccatcaggtttgggccgacgcatcaacaaagaaggccgctaagcattcagcgcatgaaaaagcacttgccatactggtgaatgagactggcttttcagagcgagctggtaacccatacattacatctttagttgatagaatcggagttgataaccttccctctgacatcaggaaaggaacgaacacttcacagaaccgtgatttggaggaattgtctgagtgccttttcagttccattgagtctggtagctttcgagtatactgcgaattcaagaggatattgaagacactcggttacaaaacacatcaagatggagcaggctgcatccgtatatggagatgtcttcaagactgagaacttttgtgatccttggcccgaccaatctttatggaattttaccatcgcagagctgtcacgttacaaatacatggagaagttcatcgaaaggttgaatgatttgagtgtgaataggtgtgtctatgccacactctgcactgtgtattcatatgcagatgatgtcagggaggtgttttgctgtccatgtggcgttaatcgtgggttgataatatgtataggtgacgcagttgattacgcggatgtaatagcctcacatgttgccagactactcagaagcctgataaaaaggaggggtggcggacagactgatgctcctatttgcgcatactgtctcaaaggactgaatctgaacgtggcagttactgagaggattgaggcggtacagcagcacgtggccaaggagttgcgtaaggatgatggggtcagactgtgttactgtgacacaccctcaatttgtaagtgttatcttgagcagtcggttggatttgggacttgtgttcctatgatacttagcacaccaggcgaacacagtgtatggtgtaactcatgtgagtaccctagattctgtaccaaccctaggagtcttgaagttgaccacattgacaccgtcaagacgagtcagaatgcaggcactgatccagttccgtttaaatacgaggctgatgtcgttcccttgcagttgatgccaacgatgaacaaactactgagtgaatgtctatcactcgccggacatcgtaagaccatttatttgcaaggaagcggttgtgagcattccaggattgcccagtgcgcctgccctgaggaagatgtgatgaccaactgcatatatgtgaacatgtgtgtaacgtattcaatggctatgcaactcagagacgctctccacaacagaggcatcacattggttgttgagtgcattagctgtggtaaaacgcagctatgtcctgaagttgaggtaaacgctcttgaagcatatgatgatgtctgcgttgatgtagcagaatactctgtgaaggttcagaactcagaaagagtatctcatgaatttataggatatgaatgattgcacaactttgttgaaatgattcacgaaatggcctgctgagggggcgcgtcgcacccacagtgggagtcatctgtggcgctgtaaagcgccccagtgatgtgtatattgtaca

SEQ ID NO: 109 - DNA, 1910 bp, Unknown
  derived from dsRNAs of unknown virus
gtaaaattaaggattactctgataccaatttttgttcaaaatgagcaaagttacaaccccggaagtgatgtctaatgaatggcagatcaagtcaagcaagtctaagtccagctcaaaaaagaaaaataaaaccaagtcaagtggcaagaaaaagagcgggaaaaaggctaacggcggagctggttccgtcggaaaaaaatcgatcgatgatgaagtagtggatatttccaatcttactcccctcctgctcgaagaggcttgggaagaagatctttctactcaggcggtgaatgccaagaaatggcatgactatatcttgaaaacgaaaaagatcattggtttcgaaaacagctgcattatgatagatgatgattctctgatctgcaaaggacctgatctcgttcggaaattacgtagcaactcgctcgtcggaatggactttgaaatttttgctgaagatctggctgccattggaattgactgtgtctctttctttcctaatatgcttaaaaacaatttttcttttggtgatcgcactcttgttcttgacttcattgatgatgtggacggcactaaatacgtcgttgaaggtacggatattgttcttgagagttctgttgatgaaaaaggcaatgtgtgcaacgttctggcgaaaaccatttctccgaaagttcctacatttgcagttgctgatgattctgaatccgaagatgatgtgaaaggagatgaatatccttcttcaaacgaaatcgactctgatgaagatactatcaactcaagcgttgtttcagaaatgactgagagaagcgaaattgatgaagtgaaacagatgatgttgcagatgcgacgtgagatggagactttgagaaaagagaatgcatcattgcgagtccgcagtgctgcgccgatgaaagagaaacctgccgttaaccggaagaagatgcgtaagcagcaagttcctgcaatcacccagctcaaaaagattttcaatgacgttgaattctgtggcctttttgaaaccgaaagcagtggaagtggagattccgaaactgggatcttgactttgaaaatggaagacgatactcttttgatcagcttcaaatacaaagtggttcggctcaacacgagtgttgttccgtcaattcctgaatttgcttttttccttggccgcggagcttcgattcctttgaagcacattttgcgtattgcatccggttcatcatgtgataatccttttgtcggatttcctggtgaccatcattccatatgcattgaagctccgttcgcacgtaacgttactgaaatcgtgcactaccgtcgtaactacgggaaagttctcggtgaaggtggaggctacgatttcagcagtgatcatatccctgaagtgacggatttccgccctctgattggcaattttctcaatctggtatgcaacggtatgagaaatcagaccgacttcattcgaacacgttctcgaggtcgagatgatcaccgttctcatggatctcgggattcgggtgataatggtcatctcagccttgagagagttcatggagtatgcatggcactcgttgaaattcttgatgtgaaagtcgaaaaagacacagacactaacgaagatgttgatatcgttaaagccaacgtgtatcgcttttcagtaaaagaggaagtgtacatcaaatttggcatggtttttggagcacggagcgctcaagtcatcattaattacggaagtttcgaagactatgctgcggcttttccgagacaggctgctgcttgttctgccacttataggcgacacagtccgggaagtaaatcttaaatcatttctagcgatcttggtatcgcgcataaagttctagggatagcaacttactattccgaaaatctaatccttactactaaacttt

SEQ ID NO: 110 - DNA, 1289 bp, Unknown
  derived from dsRNAs of unknown virus
caaacgataccaacgcaaattggctcagcgcacgggcgacgaaattgggatcgtggaggagctccactattagtgaggttatcctgggatgtatccctgatcgttgtggatcagggtactccttgactatgtcaaggtggaaaagggtgaatccgttcaacatagcggactcttactgtatggtagtaacgaactacgctccggtggtaacatttggatgtcgtactccttacgtcaggagcatacagggcggcgaaagcgatctcatcaatatgtttagtcgttgcatagccatacttgagtgataatcaagtatgtgatctgtgcccatcccgaattcttacgactccactgcaaagccggtagcaggggacaaccttgtagccggcttgtgcgtggcacccgtaagggtgtttcattctacctttgaggtaagaggccgatgtgagacgtcgcgtgacgtcgttaatagcatctccttctggggtaggactcggatagtatccgagcaaggcgcgcctgtgaccgccaggcgttaggagccatgacccaacatggtatacctcattatctttggcgttcaaacgcagagcagatcggacatggccttacggcatttacatttgaaaaccacgagccaaacgtggggaatgggcccgcttaagtggtccccatcgaatggtcagaacttcgctgacgatatgtccggaatcactctgcggctcgatcgacggtccgatgcctttaaggggtaaaacgtgactgcctttactttccgcctcacaaggccgatgatacctttgtctacagaaggcaagggggaggttcctggtttaggatcgaacgttgagtacaagatagatagctgcttatcacaaggctgaaaagccataagaagcagacacaccgtttgtcgacacccctggaaggccagggccggcattatgaagcagactgttcgactgacttctaggtgcaaaccgctcgtaaattgggtttacgggtcctcgaataaacatacacttgaccactacacatggaagatttgactacacagggaggtgataggatgaagattgaaattgatgtggataacgatggcacaactgacatcgctctagacgttccggaagggatggctacgctgcgtaagttggtcgtcgtggcgacggccactgtgacgggactttgtgccctgttcggtggtaacgtcattgtctgattggatacaatgaggcaattctgggggatggcgctgccttgggcgtcccagagccaagtgtgtacct

SEQ ID NO: 111 - DNA, 1591 bp, Unknown
  derived from dsRNAs of unknown virus
gatacttctgcattgtgtgtcggtcgcgatggcttatcgttcgagtcgtcagcggtcttctagacacactggtgggcatcccacctctcgcattccggctgattcgatgcccattaacgtgggtcttcgcgtcctggaaatcgttcaggcaaccgctcggaatactcgcggtcccctgacgatcacaacgtatggagcaggaatcctgggtcaaggactcgcggcttcctccatagatcaagcgttgtcaacaatagcggacctgaacaccgtccgcgcaacccttatcagggttggactgaaactggagggggccgagacttacgacgatctagcggcgaaaatggcccccttcctgtcgcttcccctgtcagaccccctgtccatgtcggggatctacaagttgcgcgctgggctgaaggaaactgaggatcttcttcggcccacgtcccaccacccggcgtttcccgaggatacggttcagctgattggactgatgggtcagggtttcaaacccgtccccttcacgacatatgatgatgataatcatcgtcctctccggtcgtatcccctcacgatgtatccgggcacgtactcagatggcggtgagcgatggtggttcgtccaggggttgaaaacccttgactttcggaagttgggcattgaggccagattcgttaaatccggtctcggagtctgccttggcgcgccagaaggtcagctagagtacccggtcgacattgacgctgacatctcggatttatcgtaccaaccgaccctcgtcactgtcgctcccccgccggctgtcggcgctccagccaatgcgctgaggaccccatatgcgaatcgcattgatattgcctctcttgccatccctcacgacgcggtagtttacgatccagagggcgctaccggtctagcctcaggcggcggtcgccagtcgtgggtggcgtatggcgacatgactttccccgcctcccccgacgatggtcaggtcgtcgtctccgccgatgtcgtttctgatatagagccatcggtgaggacagtgagtggcgagcgcttgacggggggcatcttcccgcacccgaccagtggtacctatcgatcatacgccgacgaccccggcaactactccaaggtggccggccacgcggggatgggcgctatcacgttctcgtggccccggttacagacagcggtatggggcgattgtttcatcatccaggagaaggagctgtaccttctcaatgaggcaggtgtggattcgagacttcgttacgtctccagtgacatatctactgccctcgcgggtgttcccgccgattccgcgcgcctgtttattccgaaggcggcggatgctgatctcgcgcgccagcgcgcggttgacagcggaagtacgttcagcagggggtcgctatttccaacctcgcctcccgcccatagcatcacagctagtgctatgattgttctaaaatgcattgataccctcgaacagagtgtcgatcagctcatgcttgaagtgtcaagacgtcagagggacccagcccctctgctggcgtaggccatccccacgcagaatactaggtgaacc

SEQ ID NO: 112 - DNA, 3644 bp, Unknown
  derived from dsRNAs of unknown virus
gggggcaaaatctttaacgaatctagataatgtacctattctaacccactgaaataattcgggatattatattgtccaaggtgattgtctttcctgcatatacacttcgtctctagccaattccaaatgcgtagatcgaaaatgagctactaaccttttacattgtctctcatactattgtaatgttcctggaaaatatatgtgagtaaggtttgaatttggtgatttatgtgtaataaacataggttcattatctggatcatcgaaattatttattctcgttaaatgttcatattaacgatcggttaatgcagacttccaataattccggttataatcactatcatgtggacgcaaatgtatacatataatttttgggagtatcgcatttgatttgcaattggcataacactcctcgcctccaagttttggacaacatctataatcatggtatgataattcccaaatatctctgactaaatccgagattacggttatccaatcagaattatccggcacctgtgacaatcgttttttcaatatttcgtaattgtctttactaaattccaatttacatccgtttcccgaactcacatgcaatccattgtaaattgtcgattacgcacctcccgtacacataaatattgcgtccttgaatgttcttatgatactgttatatgattcaatttaccttccattctattactattaattctacgcgttaatgtttatccgattgatctaattacgtatttcacgtataggtacgtgcacagatcttataatctcttccaaactctccatcaatttgttttgtaaatctgtcacacatataatacatttttatgaatagttttcaagcaatttattaagtgtgataactacttccttctcaaaagtgatagaaaaaacatctaatgcctcttagtcttatagtggtaattggacgggaataccgcaacaaccaagtaaacatggtaatcctcttatcaaattggaacatggtataattatctactgtagcactcccaattataccggattttaattcgggtctcccctagtgataaattcagtcaattatttcattcggagaatatgctcaatttattaaatttccttgaatcggttattgagttcaccctccgaaccaagaaaaaatttacgtgatctcccaaaagcctcttccaaccggggtgtctctgtgctaagcttggatcccatgatcattatacactaatcggcataaactgaatcgtccttaaaattaatgtatttttcgtgcctattgtccaatggttatttttcatattcaagtgcatttttgaaaattttgtcacaaagaatttggtatagttttgcatacacaatatcatttgcgaaacgaatactattatgtccacttccaatactaccgtttttattaaaagtcgatgaatctatttgaagttcagtcccttataaatatttttaaaaagatgcagtgcataacccatgttaatttgcaaatacttcagatccattcaatttctactacactcctatttttgggagtttcttggaattaaggacactagaagtgtgtctcaaagagttttcttctaaaatggatagtgtctattaagcatcctgtggagttatatctcccgctacaaaacgtggcagataattcttaaactctacctggatctctctacaatcttcaggattcttagtgaattgtgctttgtaactatctccttttaattttggcgcgtaattaacttaaattgttttcccatttattatgatatcttcatgtacagaataggttgtaactatcatttgacctttcttcgtgtacagcttagattaacttttggttagcgatgaatacatcaaatatcccataatgctaaccggagccaagggctcaaacggaattcccagtagttaatatttctagatattcatagccaaaacattgtctgattcagaggtctatgggcatttacaaatctcctcaatagatacagatctaagtttccttgcaaaataaaacatccgattaatagctaattatttttcagatcttggattttatttttatatagttgaaactttttcgtgtattggccctatttttaaaaactgattagaatgtactcgcttcaattttttatgttcatttttatttgggttaacataagggttattagccctatacacacgttcttattctctctaagactgagttacgtcttcctagatattgccttattaaatcagtcctcctttatctatcgattctctaattagcatcaaatgcgccaaaaaatcataaccctttgtttctcgtgatattctggaattttttttcttatataccaatgcgtgacctgatgagccataaatcgagcaatgtattccaaaattcgcggattgttctggagcagtcctaatgtcagttgaagagtcaaccggaatttagtatctactttcaaatgtcacaagttcagccgcactaactcccgaagcatttaattattacaaactaataacaagattgtataatatctcactaattttcatgatcatctcttctgtagacatttcttccatttttgaaatcaattctggcttagattacatcaatcttctccaatcaacgaaaaaatctttccattcttgaggatctttttccttttacatcatcaacaaggccatatgtgcacatccaatccaaggcatgttgaagacttcaaaatcaacctttttccctcctctttttaaattcattggatattgataggtaaatttacacattatttttccaaagttagatgattttctatcaatttcaagacgaatttttccatttttaaggttttaggaaaaataaaataaattaaaatgctatatgatatttaaattaggttcagttctgcaaaatcgtgggacgtaatcgtctgataagtcattttctccttcctcctgtatttcattgcctgagtcgcattttattttttcgcaagatggttaagttccacagaatctatcccattatcccaaattcaattcaccactatcctcctatgtgtcaaatcctgccactatgtcaaaataataagacattgaaataatttcttattcatattcaaaatccacgtcaaatgtggtttgaattctagttttggtgcacaatatagcgtgatatttgtgtgatccaaatctggaatgtaatatctatgattctacaggtttaataatgagtataaattcgtcaaaatctacatcattatatgtacactaatgatattttttgtcataaatgcaatgatgacaatacatcactggaacgttacatttatgtaaatatctgatttaagactacgcattttgactttttaaatcaacaccaaaaaatgaagataatgtcctcaaacaagaatgagtgctgatgttgtcttcgtagtaaaataagaaatctcgagttatgacgtctaagtatcctactctagactcgtcctcaattcttaataatgggtgagtaagatttggcgtctcaatcaatttccgataatttttatcgggcggttaaagcaagtgttctttcataagtttttcttttaaaaggtaataaaataataataataattaatttt

SEQ ID NO: 113 - DNA, 1715 bp, Unknown
  derived from dsRNAs of unknown virus
agaaatactttttcatttgaagcagtttttactataaaaagcggagtaatgtaaaaggtgtttccccgtagtctaacagtgttagacttagtccaaggttaatagctctatgtgagtgctgaacgactacttctctttcctactcacgcaggtacgcggatcctagggtagttttggcatgatatatgttcaaacaatacgcaaccaaatatatatattgatgattttatattcttcttcgtttttaccacgtagaatgttttctacgactacgattcgtacccagtacgtctatcatttcttatctgttgattctatcagcaaatatttcggcacttacttaagtcccccttctctggaacagcctaataatttagctgtttttattttgtattcggcttactttttagttacgaagtctcgtactaaacaagtcggtaatcataggctagaactattcaatgttttcgccctcggtgttttatgtgttttacttttatgtaatccatatcgtgcttctttcatagcttcttgtgtttcaggtcgctattcacgccatatcccattgatactttctatgttcttaaaatcagtccaggactattcctttaataatggtctaatcaatcatactgtcgcttctcgaatagagcgtacagctatcctggatttcctactttgtgttatgtttaacatattggtcttattaggtttgaacactaatcattcagctaatcatcccagtgagtctggcaaaacagttgagattactttaactcatgtaaatcttcttgaatatttagactttattaaatatttaaataattttggaagtagtagttttagtacggtactattcggggatacatcgagatttaacagtctcttagttaatcaccaaactgtcagtactttgcgcaatcaagtattacagttatatattatgattgctaattgtaattcagcctcaaataatgaccatcttgcagataacatattgttagatcagcttgctgctgaacttaaattagttgttactcatatcgaggtggctactgtcgatatcgacccttctcatgttcgtgatactggcatctttatcttcggttataattatttggagcgtttagaatcgggtcttactaagttcttcactagagttgacggtgctagtatcacctccaacgctatgttgatgttttcttacttaatgttgccgactttgtctcatgctatggttaataataaaacaattccttctggtataagtaatagtgatacagtgtatgacattgccgtacctattgttgacgttgtaacctcgttgttagatgaaacttgtcatgctgaaagcaatgacactgcacattccccaggtggtggtaaacgtactgatacagctgctcaacagctcacatctgaagtaccggtaacaccccaatccttagttgttcaacctgcggttgcatctaaagatgacggagcgcctgatggtaagttgtcgaaaggtacctcgcgtgggaaaggtaattcttcacgtaatccaaaagttaaagctggtaagctacatacactcgcaggatctaattctccagtaactaaatctaagaccaataatgataccaagaacatcgtatctaaattagttactaaaatgaattctaaaataggtgcaaagaaatagttgcttgcaacagagggctcatcccctcccc

SEQ ID NO: 114 - DNA, 1111 bp, Unknown
  derived from dsRNAs of unknown virus
gaaaaaaggagagtttaaattgagaaggctatcaactgcatgtgcagactctccgtagctagcgccaccactggcgagtattcatggctcttgataaagagtcatctagaggtctagttgtacccaacacaactcataggttttaccgccacgcaccgaacctaggcttagcaagcaggggtggcaacttcttgaaacatgaaaaaatctggtcatgctgagttaaccagccagcacgcagcgggggggggtattcccgcatttgaaacatatcctaacaccgccagaagtaaggcgggtagcgaccttaaacgcaagattcggacagacagcaagcatctagtcaaagctgcgacagcagaaagaggatctctgagcagagctatacacgtagcagcttggagagctcagctgcaggaggtccgaccatccgcttacgtcaagagggagcacgccggcccgataagaacaggtctggctatgataatgctagttgtagctatgtcattggttggacaggtccgcggccaactggtccaaagcggaaagcagagatatttacaggcggacacagactcagagaccgaccctggctcggtctgttcgttggtcatcggtggctactgtgacaaggaccgtatcaggttgtgcgaccgtcggccaggcacggtgggtcccggttgcggcccatggagcgatgacttgatagaatggttaaatatggacggagggactgaatatgtctatcttcagtgcgaacgtcgatcgcgtggggaaactatgacctttgaagtctctagccaaaacactgatcaagactggggaccttgggcttttactagcacggggcgcggccgtatactagagaggctgaaggtaacttgtgttagcaccaacggccgtgcccagttagaacaaagccacctgaacccataggactagtctaacacaaaacaaacaataggggacccagacacgtccctagaactctacgcgggttaacgcaccacgtacagtaagtgtcaccgccggcctgagaaaccatgcggttctgtcgcccgggcagacaaaagaccacgagtatcaccacaataacatagaaacttttaca

SEQ ID NO: 115 - DNA, 1086 bp, Unknown
  derived from dsRNAs of unknown virus
ggaattgcgaagggcaattccggattgaggtctgaagtggaccaacgtccatccacatgtgcaaaggtaaactaatgcatattgacggtaaagggcactactcgaatgcccgatgggggggcaatctcctccatgcgatgccaacggtaggaaagtcctggctggcggcagagcacaacaatcgtgacagcgttgcaattctcgacacggattggcttcacttcatgtcttctcctgacggagactggacgaagtggtggagaaaacccgaggatcggggaaaccagcatgcgttggacgtgatggccggttgggcatccgtcctcacagaccgggcaatgcaggagggtcttaaggtcgtaacaaacctttcgaacatcctaccgattgtggcctacggtaaaggcagtttcccgtccttcgggcggtcggctgctgctatcaacgctctttctattgagcggggcggtgcaatcatcgaaactgcgatggcagcgcggtgggttgatgggtggcgcaagaacgcccattcgcccaacgtgtccgcgatgatcgagctcgaagaaggtgagtaccttagtcaagttctcgactgcggtacactcaggcatgtcacctccgaggagtccgaatcctttgaaatctgtcttcgcgactgggttcaatggggtctggatcttcaacagtacggcgacgacggtccagtggccgatggcgctattgtgtacggggccaccggtcggtggttcaagaagcatgcgtcgcgtaaagccaagttcgtcaggcacaagggtctctcgttccacaaggaatttgagggaactcctgggcgtgaaggacagtactgggagaaacaactggagatgtccgacagacttgaagtcatggcgacagccctgaagcaaggtcgggcaaagtacttctttacttgcaagagtagagcggtagcactggaacttcagcgtgagtttcccaatctcatggtgctgagtgcgagtatgtgggcgcgagacgttggctcgtgatccactgggagagggtgtaggagactacatcctcaaggcggtccattagggccgcctagcc

SEQ ID NO: 116 - DNA, 918 bp, Unknown
  derived from dsRNAs of unknown virus
gaatatttttgcatatctcacagaaccatgtttacgtatcatcgacagagcgtaagcatgcctggaagacaggtgccggacctgcccaccggtcgcttgtctatcgaggagaagattgaagcagttaactcgctaaccatatcgattaaaaacgataactcgctagtatcacaattcaacattggtacggatgaaaatggaaattttaccgttctaatgatgaatgtaaacgttccatggaataaccctattaaaggagtggaggtttcgtatgatcatgtttgtacagatgatgctaaaaccgagatccacccgtatcctccgctaatgccgtggtccaacgcggacacgacggcggaggatagtttggtgaatatggaagaagatgttgcgaaggaggcgacggataatatcaagcgcaaatcaatgagtaatgattcatttgaagccgcgcgtaacgcgttgccgcggattaatactcctaggggagtatccgaggcagatgacgagtcgttgtattcgcacgaagaacttaggagcttgcaagcgtttctgaaagcgtcttcagttggtaaaaagtacttccttaagatgaagaaggatggaggtcttttggctgacatgaagggcgtagtcagtatggtaaaaatgacgaaacgaaacgtttatgttgttaagaaagacgacgcgcatggcgatccgggattcacaatgattttgtcaaaaactaggcctaagcattgcgttaacatccgtgacctaccaatcggcgtagacatctggatggcgaaaaaggcgccaaaccagaagtctactcccgttaccgatatcgaatacacgatgttacaacacattcgtgaagcgatcgttagttactttaccttctaatcgaatacgagttgtgcagaatgaacatac

SEQ ID NO: 117 - DNA, 908 bp, Unknown
  derived from dsRNAs of unknown virus
gggatttaaagctttaacggtatggatgcacaggacgctattctgagcagcggtagttccgcttcgttggtgaacacgcttagggatttggttctcgattgtttggttactgtgaaaaatggacgcagtcatatggtcatctcacctccaaatcgagcactcatgttcgatgattgggctatcattgaaatgggacattatagcatcgatgtgagtaacgccactgatgtagcctttatgtctatgttaatgagatttgttgccacaggtgtaaaatcaggggcgagcttcgatctgattgcacaatacatctctatttatgagagaatgcgcctagttgacctctcggtactagatgccaatctgcttgtaaattttgcagctgtacaaaggtctgacatagcagctagagcatttatagtattgtatgaggtatacaatataaatgataagacagcagatctgaaacctattgtcatgcaatcgattcaacccttcgtgaacatcttcaacaggttggaaaacaggcagacagttgaatgtccaagtcactcatttatcggtaataagatgagatctgagtatatgcccagattaagcaatttcatagaacagaccatgatcaataataatggggataaagcaagaagattgagaatgctgagacctaacaatatgatggtaaataatactcctaacatgatgaaggcctatgatagttgtatgagcaggaggattgattacaaaacagcagctacattcatcgacatgcggcctgccgctgccagagtctggcgatagtgtcttgtgtgacatctactcccgatcggcgtgccagtcactactcgtaggactggcagcaccaccgtcgatcctgagccgaaagccgttcatagtgataacagacc

SEQ ID NO: 118 - DNA, 912 bp, Unknown
  derived from dsRNAs of unknown virus
gaatattgaacagcggatttgaacgatccagtattattcaataaatcatgactatcattgcggcaacaaattcccatgaagatacaaatgacattgccggtaaactatgggacgcagacgattataaagaagtgtcttctataggtgatggtatcgaacgcgctcgagaagtaatatctaacctgatgagtgagatcacactcgatagcgttgaagggctaacggaaaccgttaacaaaattggaaatgtagtgactgaagtgcgaaaagcagtgatgcgatgctcgatatatcaagctgttacagcatcagaacacgcagcaatggcggtaatatctgatgatatattcaccagtctatggcagctaaacaacgacatgcttaaagagcgtctatcaacaattgatacacgtcgaaggcacatgcgtaagcgtgaaagggatgcagatactactacagttattgagaactccttcgcattttctatgtacataacaagctatgaagtcttagttaatgctacaggcgacattgtgcgtggtgcagcaagctggcatcaccacatgtcgcttatgcatgatcagttgctggcgctagctcaagatcccgacaaacttgatcctgaaattgcaacgacagtaaatgatgtactcccagaacttgagactgatgatctcccggagctggagactaatccatcaggtgatacaacggcaactgcgggcagcgacagcattgaggtgacaagtaatctgagtgattcatcacagggcacacgtgcccaaaccgtgaatgaaatcgtaaggtcactcacaaagccaaagagtccaattgatgtataatgtagctcatgataacgtataatagtggtggtgtcgcccaacttgtcaccttcgctgaacatgtaacatc

SEQ ID NO: 119 - DNA, 928 bp, Unknown
  derived from dsRNAs of unknown virus
gggattttttagtcaaagagatggctcaacaagcacctggaacatcacccaccacgctggtcttcgcgcgttgtgacgtgcaggcctaccggtttggaaggtcactaggatattatgctcgtgagtacctcagattaaacagcttacccaacacaagttctgcagcaattagaacagcaagtttcaacttggccaatgaatctttatctttaaagaaccgcactctgtcccctcttcccttgaatgtgctgactcagacaatagcttctatagtcagtcagaacgctgacccaactgatcagtcgctcatgttaccattcatcaaaggcaactttgctgatatgagttaccctaccgggatatccgcgttgcgtggtactgccggggatttcacaactaccaacaccttgtttctttatggtaatgatggtactttctattgggaaggcaacatcggacagcaggaggttgtatctgcatctgtactaagtaacgagaacatgtgggtttcatcagaaagaggtaacatcacaattggtggcgcagccagaaagaactttaacatgtcagctcctttcactatcaacctgaatccgggatctattaagatcagggttttggcggcctgttatttgccgttcgatgctgacttacttgaggaggctcgtcttgggtatgatagattcaaaaagtatgctataggaactcttggaggtcaattctacctgcctatcagtattgacactcttattgtttcagcatacaaacaaaacagattccagacacatgtgcctgcgatattgattgctttgttttctgcgtatgaggtggtttctaggtgctactgagctcagacaatctagggtgtgctatggggattcctcacgttcccatactagattgactgtcttatgaactaaaacagacc

SEQ ID NO: 120 - DNA, 1017 bp, Unknown
  derived from dsRNAs of unknown virus
cgcgtgttgagtctttttcggcgaacctgaccctgaccgatgaagggttgcctgccgaggtgggttggacacccgtcttcagatgtgtgaccttcgcatccgggtacggccccgacacacccccgggtagtagtagctggcgattgatcaacagctttaatgcgccagtcgattacccctcgggtctcgtaaaactcggcctgaacatacgcatcggcccaacagccagcaccaactccgtcgtctggacgtacggctccgtgctgaccaacggcatcatcatcaactaccccatccctgaacagcggatgggaccacatgaggtacaagattttacggtcgactatagcttctctgccatagactactcgtccctcatatcgggcgcgttccccccggggtggacgctagccatactcgtgaacggtgcggggcaggtgtggatgggttcaactggcatcgggtacgacgatggcagcaccattcccctgtccttctcaccagggcagtacgcaagcatcaaccaggcgggcacctacgtgcctgttcgcatcggcattcttgaatatcgctttccttaaccaaaccatgcatgatcaaaatctgggaagaaatatgcgacaaaatcgaactgttggccgctggagcactcttgctgctgctgcgtgccttattgttggcgtggcctgcactctcacgggctgtatcggtgtggctgtcggcagctatcgctcgacggcgcgtgaaacgaacggcctctcgcgagtctcaaccgcgcgattcttcgcgacgggagacgcggtgaacaccgttgggactgctcgcctctcggctacgacgcgcaccaccagcatcggcttgactgacgtggaacaggtgaccacgtcgagcaatctggtacccgccattcgcgcgggcgtcgaaggagctacgaaggctctggtaaaataaccttcggcgtccggtcacctgagtaccgacgccagccggtggatctacgatccaccggcactttcc

SEQ ID NO: 121 - DNA, 1465 bp, Unknown
  derived from dsRNAs of unknown virus
agaaaaactaaagaaggaattgagctcctaccccgcacgcgtaacggtccaggtgtgacccattgaatgaatcccctggagaagtagctgtcgtacggactagtatcgtgaatgctgaggatgacgaaagtcgacggcacccattggatagtcgtattgcgatcaggactttgggcgaaaatcagcgattgctacggtacgatgatgtctgtcctgcttatcgccaagcgtgcgtgggtaatgtgagattccctattgtccagtttttctgaagcccatcaggaggaaacatgtcagaaaagtggatccaacaagtcgtgaacggacgtctcatctacgtccgcatcgacgagatgggtgggagcgcggccgatacccgggccgtctccagtccatccgtcggtgcaggcaatctggacttcgagaccatgctctggtcgagtagtctgtctgtgcttctgtcggatgacgcaccggtgaaggttgcccagcagcccaccatcccgaaggcggcggatcgagatcactacggctactactatcgcaaggatctgggcaagtgggttcccgctcgctcggattcgggagcagtcgtggagttcaagaaccccgctccggaggagaagcccttggaatccccgaccatcgaccccatcgacttcgtgtcgggtggtgtcgtgaagaagggtggctccttgctcctggggtggttgctgtgaggcgcatcagccggttgcttgcgggtgtgacggccactatcctggcaacgggatgtggggcaagaggtcgggcagcatacacggaccttagtcgtaccgtgtgccaaaagaccgaaggccgaaccatctgcgcagtcctcggtgaggtcacgtcggcgctacatctgcccaacgtagcgtcggggtgtgacaccgtcatcgacaaggctgggtgggtcgcggacgcggcgctaagcgtcgtgaacgcgatcttcccgtcccagaagggtgcgaagtgggaggaggcggcacgagacaccgtcaactccctcggaacgcccggggctgcaaacgacacgccgtaagggtacgggggtttaccatgaccccgatctcgggtagcgcccgagtagatgaggtgctgaaatagaacaaaacctcactatcgttcctggagcgagccgcggacgggtgtcagcgctgcggcaacctaggtaggccacttggcgaaagccatgaagcagggagccctatggaagggggctttaaatcagtggagggatcgaaacccaacggtgtccggattcacctccggaggcttgggctgaactgaaagtccggcgaacggatggaccatacgcgcgtagatgatcgtggcaggggtcttcgccgtccggagtagtctgcacacacctcgaaaccatgcagaggcttggccagccgtccctgcggagggaacgtgaatagatattcacgtcccccgctcc

SEQ ID NO: 122 - DNA, 1532 bp, Unknown
  derived from dsRNAs of unknown virus
ggacgcgggcttgtcgttcaaccgagcgcgccgtgagttctccggactgaactggaccccgatgggatccgtgtggtctggctcggccgctggagtggcctccgggccctacgtcgcgtacgtggccaacgtgacgaacgatcgctcgtatcagctcatcgtgccggaagcgatgtcggcccgcatcgcttccatcgatccagcggatctgtacgccgcgagcccttctctcggtgacactctctcgaccgaacgcatgcgtaccgctctcggcaaccccgcttcgttcgctaacgacacccttgctaaggcggcagctcttgctgaccccgctgacggctctccgggcatggcgttcacgcccggtaccgcctctaactaaggaaagccatggaccagccttttcacatcggacacctctacggcaccgttttcgcactggagacttctttgcccagcgtcctcgacaccatcacgttcacggatggcctgccttcggcctcgactgttatcacgcagctcgcgaccgttggcaaggagatctcggttcaagacgccgaactcgtcgctgcttcgttcgcggacttgcggagccatatccacggcgcgctcgtcgctgcacagcgcgtcgagaacgctctggctgtgctgcgcgccaacggagagctcaacctcgaagagctcgtgtcgcaggctaaccctgcggcgccctccgctccggaacccgagcgtcaccaggtcgtccacgagcatctcgtgccagagacgttcgacatgcgagctttgaacctcgttctgatcaacgtggggcattgcaaccctcggccctttattcgaaagcggcttggcgtgccggccatctggctgggcgaccaccaggtgcttcctggctcgaagctgcgcgtcactgagttctgggttgacaaccgcatcgacgacatcgtctgcaccgtcgttccgccggacgacgcggccgccgctgtcgcgccgggagcgcaatcgacgaggctcgacaccaggtgaaaactactcgactcatcgtcgctggccctacaactggtaaatcgactctcgcataccgacaccccgaaatcgccgtcgatttcgaggactggtatcgaaagcgtaacggcttcgcaacctactacgaacccggtatgcaggggtctcccccgaaacgggccgtagaaacgaagatcgcgctcgtcaaagagctggctgagtacacgaccgcacctttcgtcgttacgtcgttctggaagaacgatctgcttccactcatcgtagcaggtgtcttccgaccgatcgacgacgtcatgctcgcggacgaagccagaatggctaagttcggcaagccgccgaactggtcacgcgagaccgttgccagctggaacgccgacagccagatcgccagcctgcgtgcccacggcaaagcggtgttcatcctcgagaagcatcagtttctcgcggacgtgattcccgctcttctgtaatcaccccgggccctctctaacgagagggccctcccttcc

SEQ ID NO: 123 - DNA, 1674 bp, Unknown
  derived from dsRNAs of unknown virus
tggtcaaaagagtaacaactctttctggctgtcgaactccacacgtgttaacacgtgcttgacttctttgcgagctggcgatggtactgatcgggtcctgttcctctcttgtgttatagtacaaccggaaatgccgcttgttgatgaggttgtgttctgctaggtaataaatggcttcgggctgttgaatctagtttggatgcctcttctgatactggcgacctctttctgatcttccgtactggcaggcgcttgcgccacttgatgactgtgactaggtactgcatgccctggggttccgtttggggtgtggctctttccctgccactatctgcgcggttcctctggggtgatacctcccaaacaagtccccttcgaagcgaagggccgatgtaatttacgtccgacagacagagttgctcttagactgttataaccccagatagcatgattcagctgtaacaggttgtagaggctaaatccttagtcttaaatgtaagctacaatacaacagactgcaatgctatctaccttttatgagttccgaaaggaactcaactaatgtaattttggtgtacccactcgatgggtacaagctagttgattgcttaattcaggcattttgcctggccggtagaggtcttagagttaggtggtgtagaaatcgcttctgatgattctcgtggtatcgcatcacgagatggtgggcttacagtgcctgctggccgcaggagggaggtcgaaagccattgctacggaaattttacgttcgtgggttctccatctacgcttttattttccagactaaccggggtcgaatcctatgttgcaacctttaaatcttaacgattgcttgataggataagcgccctcctacgtgacttacagtgtctcggttgctccctaacgtgcgattatccctcgtgtgtaaagatgcaagctgccttcaactcgctcatcagccaaccccttgccgttccgaccaccgccctcgtgaccagtgaagttctcgagaaggcaccggagcaaaactcgccagcaagcagctggaattgctcggcaagacaggtgctgttgccaacgtggctggatcatttcaaggtgcagctatgacggtcgacgacattggaaccgtcaataaacgagaccaagcagacatgcagttttcaataactcaggggcaactcggtacgtcgctaactgacactacaccggtgaacatgggcccaaatggcgtccccaatatcgccgcgcctggtaacttaccacccgactcaatcatcgacggtggagcaggcatcagcgatcgggtgaaggcttacccaaccaccgaagggccaatgcgcatacctctgcgccctgaattcgttatcaaagacgcaatgggcggcaaggatatcaagaaccttgctgcagctaccgataatatttactttggcatcacgaatgccaacgtacgtgtccagatgattacgccttacaacaatgttgcatctaagaactcgcaatatgcatcactcatgcataatttcgaaagacttaagattgcacgagcaaacgctgaacttgaaggttggcagggtaaccattgggcacctaacgcgttaggtaacctatcgggtggcaacatcccagtggatttgattaatcttgatgctgcactggctggagcgc

SEQ ID NO: 124 - DNA, 1974 bp, Unknown
  derived from dsRNAs of unknown virus
gggaaaagctttctatggaaaaacttaggagtgagttggtaaccgcccaggtaggccacaccggattagccggaccccaacgcagggcaacaaaaggaggaacagaagtatggatgttgacgaacagacaaacagacaggagcggccggaaccgcaggaagaacgcataggggacttcactaacgaagtagcgtacgaattacgcaatagactggcatctatggccgaaggttggcaagagcaaaccgggcttgaagtgtcagtagtacccacaaccaatgtgcagattgaaatcagtcactcagactgtattcagtatgacatcgatccatcatggattggagaaattggtacatttagtaacttagctatctttgatggcttttacaacgttgactcggaatcgtttatcgagatcgaatttatgtcagctgttagactagtgtacgacgaagacattggcgaagaggtggcacaagctgtcatcggagtgagagacaattcatctcactgtgagtacgtaaagaagggattgaccattgaactgaatggatacgacatccacatgggtgtaccggaccatctatttgacgagttctcattagagctagttcacttagaaacagaagatggcgacctggaagagcgattggacaatatgatggcatttcaaatggaagtgcttaaaggtgcatcgatgttgctcgtgtttagatactttgaggagtataatcagttggaggcttcaagatgaagttgactggtattaaggcacgtaggaccacagcacgacgtctgaaagtggaggtagtatgggaggccctcaaggagagggacctctcattctcctacaaggatttcttggtagtataccaagagatgttcggcaaagccggacaacctacacgacaacagctcaaatcggatattcgcagcctcggtgtgcgtgtgtggacaacacaagcacccgtggctggtacggactttcgtacctcgctatcatggttaggtgcagtgaccgagactatctactaccacaggcctttcgagtccatcgacacaacgtcgcttatggaggaggagtaaatgccttgggacagtagaacttcggatcttacatgcacacactgtgcagcgagaggtttccaaaatgtgaagttgattgacgaaacctactattacgagaccactcgttatagatgggaggacacgcctagagggcgagtcaagattgaagtgcctggcaaggggtggaaaactattaaattgccaaatggtaactcagcattgattcagcgctggcgctgtccgcattggccttgcaaaactaacaatgccatccgagcccgccaaagaaaagggggacgaagatgaaatatgttatatttgctggaagtctacatggtaaaaccacttttgctaataagcatgactttgtggtggatcctgaggctgaaccacctgaagcttatgctgatgatgagtggatcggactctactgggactacaaggacctcgaatccagatggaaagaggaaagagtcttaggtgacaaggagaagcgaaaccaagcgtataacgcactcgctaagcatgtcatccttaactcaacctcaccaattgtcgttgcacatttcaacgcagccaaccaagcgttagcacgacaagccggaagggttcagctcttcattcggatagattggaacgagctcagcgagcgagttcgaaaactattcgacgaagacaaggacaaggccgagagcataatctttaggttagtagcgagctacggctatgctatggcggttggtgatatcttaccactgcctaaaggtactgagtttgccacttttgaggcggcactctctaaaatcaaacacaccttagacctgtaaggccttatggggctctatgtgatgattgtatatgtcatcctatagagggaactgatgttcctgcacaacttgtgcaccc

SEQ ID NO: 125 - DNA, 1172 bp, Unknown
  derived from dsRNAs of unknown virus
ataaattacagtaacaggtgagcatggcagacagtatcactggacgcttgggagctggtctccctatgagtcacacatacggctaccaagttcttagacaaaagaaggagtatgaccatgatacaacagtaccagctgatgcaacgtggacacctttcgagtctcatgacgaatacgcatttacggaaaccgaagtatatttgaccttctacaagataggagtgaaagtgttctttaccgtaactaaggattctaaaggcgagaatagaagcatacgactggatgtaacctggactaaaaatggaggattggcttacattgctgacagagaaatcatcatcaattggctgcagcttttgtccaatactagttcaatactgacaatgtcgcctatctttcttgtttgtgataattttgaaggcatgtatgtgttgttaccctgttccatgaacaatacctatccgtgtggtagttttgcagtgagacggaaagtgtctaagccctctgcagtgttagcgagattgatgaatctagtgccatcatccaaggacgagaacaacctttacatacagagtatgttaaaggccttgcaactgcgaagtgatgacactaaagaactgatcccttccgacggcggagcgagagtcattgcaccataccttacggacgaggatacttcagccatcttacgcggtgctcttcttggattagaacctgagggtaaagtcattcgttggtgtaatctattgactggatatgatttagaattgaatggtgcgcattggtattgtgacacgtccaggatagttggagatatgtggaagactcaaggtgcgcctgtgattacccccaataattttgatggtgaatatgccgaactgagtttgccgaccttgacggaaggaacggctctgtacgaacaatgggcgtctagcgcagtagaaactgatcacaatggtgcactaattagagctggtaaatatggcattcaatacggtcaacttactggaaatgagtctttcattccaaaatggctgcaggcactaatcacttagtgattatgtagatatttattgatacgtcatcgcattgaagcgagaaggtgtgcagtctgtttgctttccgcttagtgtgtccctactaagtgtgactgttacgatagatcaacgatc

SEQ ID NO: 126 - DNA, 2761 bp, Unknown
  derived from dsRNAs of unknown virus
gggaacaaagttcccgtcttcctcgtaagtttacgaggaaacctaaccttaaataggtgaacatcatgctaattaatgcaacgcaagatatgttttattcaacgactctctccgcagacacccaagaatatgtcgaaatccctgtacctgccggtgcagctggtattaagattctagtcggtggcggtgcaggtaccctcctcactggcttcgatactgacgctacgatcctcgcctctggctgggaatcactcttcgagaccttccgtcttgaggacaacactcgttccgagtccaaggtcatcgacttgaactacaattcatccgctactgtcaatgacatggcacacttgacggagctcgcccttctggccgctccaatcccaggtgagcagatgcacactgtctccgaccgccacatcaacttgtggactggtccattgggtgagtgccgcctcttcatcaagatgcgaagctccatcgctgccgctttcgctagcggtagcggtactgcgatcactcttcactttgtggctttgatggctccggctatcgccccacaaacctggaaacagtatcacatcggacaatcgactgacaccaacgtcgaattccgttacccatccggtgtcgtttctcgaagcgtcatcactactggtagcgactacgaccttgacgacatctacatcgatgggaagcactcgaccagtaacccgatcacaatggctatcgactacaacatcctccgtggtcacgaagcacaaggaggtaacgtgtacaaccgttacttctggggcgctaacctcggtggacagaaagttcgctttgaaaagactgctaccggtgcggtgcacttctcgtgcatctaccaggggtgatttgattgttcggtgatttcatcgatgcagtcagagatactatcatggcacctttcgaagatggattcgacatctccacgatcgccggtaccgtagtcggtgctggtgcagtggtggggattaccaccttcgcaatcgcaactgtcggccgtgccggtagtgctgttggcggtggatcagtgttcccagcgagcgtcagcaagcttgagaaagcttgggtcttctggtcatccggtcgcctcttcagccaattgaccgccgaggaacagtccaagtaccggactgacttcgcgactctataccgaacaccatccggtgcgatgaagaaaggagccacttcccgcctacgtcggggtggtttctaatgttgtccaggaatggtaaacttgcaatcggagcactattcatcgcgtacctcgttggtatgcgagtcagtgaccccaccaacgcctccaccctcaaggatcactttgctggtggtatttctcttcctatcccctatgctgaaaagcttgctgaccctgtgacccagggactgtccagcttggccctcctcggtagtagagtccccgtcgccgggggcgttaccgctgacattgtcgcaggtacctacggtatcctgtgggggtggacctactgattgaggcagtctctggcgcaaccgttacgctactaaacgacaggatagccaccatcacgcccgctagcccagctaccgtccgtgtgatgaccaccggtgttccaccggcacaacttggcttcaaatctgttgatgacagcaccaactcagttggggtacagtacttcatcacccgtcacgggtacctaatatcaggtgccctagattcgctccccacgccccctaagggctgtggtataatgatcgaacttcaaggacatggtggggtggagatacttgccgcaggttggtgattcaaatgaagctgtcgaaggcagagatagcgctggctggattggtctccaccaccttgctggcggtatccttagcctccgcggcgttgatatcggagcagaagcacttgaaacggcagcagaggcgacttaccctctggttaaaggcaagcttcctgatttcctcaatatcgttggcgtgtacggcagcgtctttgctgctatgatccaaggtgattatgatgagtacgaagaagaagaacaacaacaacacgaaacaatcgacatcggagtgtccaccgtgtccggagaacccggacgtggtgatggacatgaaggccaagacgatcagcatcgacgtgagtccactggagtgggcaatcatcggagcggtcgccgtggctctaggcgggattacgaactggatggtgctctagatgggtctacggagtaggctcaagaaggcacgccggaaggctaagcggagggtcactaaggccaagtcatccgttaagtcgacggcaaagtccgcaagtcaggccgtcagcaaagcccgcaagggtggatcctcgtccgtcaggtcagctatcaaagaaagccgcgattcaatcgttgatgcgaagaagtcagtcaagaaggctgccgtcaagcagaagaagaacgcgatcaaggcttctaagaaggcaggcaaggtggcaacgaaggccggcaagtctggcgctaaactcgggaagaaggcattcaaaatgactcctctgggtatggttgctggtatggactccaagaaacgcgccatcctatttggggttggtgctattggcttgggttacgtggccgtcaaggtactcccttccgttctgaacgcatccggaaccggtgctatagctaactatggcatcgggtacgctctgggttcacaataattaatgcattaaagccataacaagcttttacaaacatttccacccccc

SEQ ID NO: 127 - DNA, 1309 bp, Unknown
  derived from dsRNAs of unknown virus
gggatttttcttgtatacagtcgtcaaccgtgatggcgttagtcaataagtttagtcatatgaaaggagcaactggaacagtgagatgtgtgaatggcaagcagaccttgtttgcaagactagctgataagaccccagtgttagaaatacctctgccaggatgtacacgcgtcgaggcaatcgcaatacttgtcaatgccatgggtctgtcacttgtggattacgatggtggttatcactctgatatactcaacttgatgagtcagattggcacctcgtcgacttttaagctaggtaggaggtataagccattgtatgtcaagtgtctaaattttgacaatgaacatcaatacagacattgcacctactctgctattgtcaagtgctgtggattgttgaaatttgataaggaaggaagcagtttgttggttatggagagttgtaaagcacttcagccttcaaatgtcaccatgcatgctgttctatccttaatgggtagattaagtgttatgcataaagatggtatagtacatgaggatgtttcacctgataacctcatgttatcaaagaacggggacgttgtgttggtagaccctgctgtgatatccggagcgaatgtgaagcagaggaatttgttatatgtgaatgtgtttgatgacgatgttagactgaagcccttaggtgaaagaatgtcattggatgtacaacttactttgatgagtttgttgcaggtacgttacagagatgtgctggacaacttcatttatcataatggacaactacttgatagtaaacccgattacatctctgaatatgactattactgtgatgattggagagtatttaccgacttcaagagttgtgacgattttctaacatctcagtttgccgccaagaccaggaacatgttatgtaatgatgtttacctcaattctagcagcatcagtgaggatgatgacactgacgaggatacatcagcaccattgaatagcagggaccagtctatccttcttgatgaatcgtgaactaataattggggttattgatgtttagtgttaattggaatcaagtatctgtaacacacatatctgtatatttactaatagtattgttatcatcattatcatcatgtatttgtatataacctgtaaatatatatggctagacgagttaactacgtcaacggcgcagctgccagactgcgacgtatggatttgttccaatccgtaaaggttgactgtgggagggtatggcttgctgcgggtcttaggactccatggtcacttccacgtatagcttgatacagacc

SEQ ID NO: 128 - DNA, 2198 bp, Unknown
  derived from dsRNAs of unknown virus
gaatttgataggatttgttctagcaacagcaggataccagtcgcgggatggacggcattagcagggagtatggacagagagtggaccacatgatcattggaagggttactaacgaggaaaaggtgattgatctgacaggattcatgcgaggtaatgcggctatagccgatgtaaatgttttggatttgcacgcgctcgcagccatctcatcagctcatatagttgatgaacgcatgccaccccctaggggtggattcgatcgaaagaaagatcagttcgcctaccttgaccgtgctcgtggtgataggacaggagggcatatgcctatgatatcatttacagggaatacgcttccaggtggcatcaaggcgcacatgccattcatgctaaatggcaccaccggcatcttctggcccaagtccgaggacaaacaggatcagcagaccatcgagcacagcagtgcagttcagcaactgcgtgaggcagggattgatcctggagtgttccagcgttatatcatccagagcactgatgatatactcatggtacgtcatgctcacctgatagcggctgcagtaaacttcgtcttgagaaatcgccatctacagaacgtcgtgatgtggatacagggcgtccgggataggcacttgcatgaagtagagaatatgattcgtaaggaagtgacaagtgctttcgaacttgagaagcctcaagtcgtggacggagatgacgtcatcaataacaccattggatggccacaggatcctgacgctgagacgccgtggtggattcagcctgatgaggttcatgcgcagttctttgagcgcgcagccactgaactgttaaaggcttcacgacactccgtcgtactcattaatcctcatatactgactgtgcagtcgtacgtgaataacgggggggtgatcgtggcatacgtggagatgctggaccttgttcataagcgtcgtattgcgacgcgtgatcccgggaacatgcaacccactgcggcagtgccacttgatcctgagatagtagcaatcgccaaagcggcaggagcgcagaggctgtcggacatccatgttccaaagggagtaagtaaaggaatgatacttgcaccctccggcgcggggaagtcatactacgtcactgagtcacgattgctattcgacgcgcctatagtggacgctgccccaccagtcctggagcagcggatgactaggacggccgcagaattaatcgctgcatcagcgagagccgatcactctcgctcactttaccgcgtgggcagaatggcagatatttcggcgagttccggtcccatgcacgcatttccaagcccatcgttcttgatggctgtgggtggcgaagagaatgctacggctaaggactacgctgacgcaaagaggttagcgtttaaccttaataatgacgttgaggtgttaataatgcgcaatgcgcgtatgcgaaattacacgaggccaagagcgatacggcacttatacgtgattgagagtccatatctcgagatggttccaatcaccgactttactgtaccgagagtattctattacgtcgccgtcacacacgtcgatgggtatgatatgaacgcacggatgttcaagatgatatcctatgtagaggcttacaacctcatcgtaggtgataagcagacaggacgtcccatactaccgacacctgacgccaattatgaggagggtgctcgtccgctatacaatcgcgtgtacgaatgtagatgggtctacccacatttcaacacgagacctagtggaataggaggactcgtgtcgattcataatagaaacgcatacgccataggacgcagcatgccctttctggacgagttgctagccagcaacgtgaagccttcagggcacgcattggcagcattacctttgagcccaggcccattccttaattatcttatggagctgctctataacttccatcatcccgctagtgatcccttcccctttggtactgttgaacccagtaccggggaaactttccattcaacggctgagtatcaagctgctatcgacatactatcatcttatcatgcaaccgtcacgattgacacactcgctttacgggtggtcaacgcgaacgcgacgattttgaagaaggtgatgtctcgagcaggccgctagaaacggggcgaatccttatcaagaaacatc

SEQ ID NO: 129 - DNA, 1377 bp, Unknown
  derived from dsRNAs of unknown virus
gaatattctcagtagcaatataagaataacgtaaaatggaatacagtgcttatacaagggatgaattggataaattaagggaaaaggctcgacgaacaggaaatgttacgccacaagaacagaaagcgttattgaaggatagctacgaatctgcagccatcaggcactacgatgctttcctgaaaagtggaggaaaccccaaggatacatacatggacgaggaaataccgaagatgtttgatccgctcgatctcgctcatggatcgtatggtgtacatgtggacaaatatctggggaggagcccatgcgatggcccaccgggatatatcttccagaaggtaacgtattcggctggagctattgtatcgaagacgtcgattgccggcatgtacaagttatgcccagatcacatggggtacatctaccattctaacagtcttggcataataatttcgactagtgatgtgaatacatcgacggataaaatcacgtataacagtcatggctttcaaaacggagttgcgttgacgtacacgagtgaaggtggaaccgcaattacaggcctagtggacggcacgatctactatgtagttaacgcatcggataacgcgtttcaactgtcagccacttttgggggatccgcaattgacctaactggcacaggcaataacgctcaaaaattaacgccgactggaactggtagcgaagtgcgtatcaaccaagatggagcggacctttctggcacgtctgaccctacgccatcagggatttcgggtgaggccaagctcgtaccgggagatatgattttgggagcgattcttcaattagttgataccagaagttcggataaccgaacgggcttcgttactgcgggattagtctctaacgattcagcgtcacccgactcctatgggccagagttggctagtgacccttcaaatttcattactggtagctcgattagtggtggcaaaactcatgcagctatgggactcgccgcttgctccgtggctagccccaatctgaatatctatagcccctcgattgtagcaacggccgttaacgacttagcacctgctgcgattggagcgcccattaacgcaataaacgtctctggtgtgaccgcgagcacatcaaaccagattaggttcacgcttaatgtgtatgcgttagttggagcgaggcagaagacgatttctcactatacgcagccggatccagacttcaaaatggaatgtttgactaggcaattcgcaaagcacccagtatctatgatccattaaacctatgaatgcatgaaatttcatcgtgcgtgatacttatacggcctcaaatgcgacatgtcaagtcgggttcacattaatgagatgaaacatc

SEQ ID NO: 130 - DNA, 895 bp, Unknown
  derived from dsRNAs of unknown virus
gaatattgtctgagatcaaacgaacgaaccgagagaactaccagctacgacggatattcagcaatatcataataatggctcaggaacacactggagattcaactgaaatgcactggacgcctttagacgtcacagaaatatcggatgtatccaatgaaatacgcactgctcaacgagttgtgtccgctaacatgagacggataacaatcgatgacatgaacgaggcaaagcatattgttacaatcgtaggtaatattgttcaattaattcatactatggtaatgtcgtgctcaatgtacaatgccgattcggcacttgaatacgcagctatggccatagtaacagatgaaatccaatgcgcattatgggcctttcatcaaggcttgttagaccataggttaaggcttctagatttacggcgaaaatacactcgtgatagagaacgtacgggtgtaacgttaagtggagtcgagagtgggtttatgttggcgatgtatatcgcatcatatgaaacgatgattctatcaacgtgtgatacgatcaaagcggcttcgcaatggcaccaccatatgtcaatgatggctgattgcataaataatgcagcctcacatgatgccgctgcagatttagaaaacactaacctcgacgaccctagtgacgtagatggctccgaaccaattacgactgagattgaggagcgaggagggttaaaccctatcaacgaagctgcttctttatcagactcaagcttatgtgatagccccgcttcaattgaacatatctgtgaaatagtttcgaaccctaaaagccctatcgatgtatagttagtcacgtcgtaaggtagtgaatcgggggtggtccccatacttgtcgtttgagatcagcatgtaacatc

SEQ ID NO: 131 - DNA, 1576 bp, Unknown
  derived from dsRNAs of unknown virus
gaatattgtagcgctgtctatgtcataacatggacattacatatctatctcgatacagtgatggtgttaaaacaaaacaaccaacattaaaattactaaaaacaaggcaaaggtcgatgcttggcgcgttcgtggttacggacgcaaagacgaacattgatcctaatgccatattaatgcgtaaggataacgcaaagatatttactgtgagtatcaatgatgtcagaaagctaatggccacgaagaagtatagctttgaaaagacgttagcgtactacgaagcagtgacccagataccgcacgccaataggaagttatttgcttacacgaaccgtaagcatgatcctccaaacgcgtcaatcacacgtgatgttacgtatataccggaaataatatggtacaacaattcatgggttaacaactcatgggtgcgtaacatgatgaagaacgacggtggtgtcccatgcttctggactaaggacaatacggcaatttcggatcctttcagcaagtcatggaagatatatgatgagaaattccctgatcgcggctggcgtattacctatgatgtgcacgattcaattgagaaagtactagcacaactcctagacttccttgaaatgcacaaagacgagaaagtcgtgcacgtctggattcaaggtactctgaacggtaaggatcctaagacggtgattaaggacttacaacgtggattagagttcaatgcaggcggtgataatggtttattcgataacaatataatcgattttgtgcgcgggcagagaacctcagagtatctagagctttggcacacgccgcttgaggactctatcgatgtatgggattactacggagggaagacccccgttcgtataccagtcataccgtggagggtgtcaaacctgggacctcgtatttattcacgttcaattccgccgcagttgttcccacctacacattttgctaaagcgatgaacattaccgatgtgaaactaacgcttacagaagtgtattgcaactatagcgaatttgttgaaatggtaccaattaactcagatgatgcattgttcttagactttgcttggatgccggttggaaacaatctgtatacaatggcaaaaataacggaggccacgaaggggcatcttttgaaagttaaggaccctgatttctttaatggatgtgggtctgtcgtaacttctgcgcacgcgtgctttggaattggtaggtcaaatattgatctgataaatcaattagagcgaaaactgaacactggacacagtacatcaggccatatgattgctagtgtactagcatttcaaagccagttcatgtggtatctgcaggaagtgtttaataattttgagagaggaagtagcgtttacattaccaagttcgctgaacccggatctggtatgtaccactcgatatacgagtatagaaatgcaatccatgatatgaaaacggctgataaaagtaagctatatccaaactatgctagaaacaatttggacatatgtgagaaatttgtcagctcattgaagttatagatagggaacagcgcaacatgaacatc

SEQ ID NO: 132 - DNA, 1408 bp, Unknown
  derived from dsRNAs of unknown virus
gaatattttgtgaaacagcaagtattgatattgttaagtatattgaatcaagatgaccgacatggaagatttaatgaaagagatgggtaatcagaaacttgaagtgcagattagtgggactggtgcatttagtataacaatggagaatgctcgagaagaggtttcgcgtaaattccctgagttaatccaaggtgctgcagacatagcgaaatgtgttgcaaacccggacaagttcgctctaacattaccatccaggatcttaatgtctattttagctaccgcgcctaaaacggatgacgaaaaagagttatttaaagatgaacagcgtttcgtggatgctagtgagaaagcgaacgaacgcctgaggcgagctcacgcgaaaatagcttcgtataggtcgagatacgcattgcttgaagccgaccatttcactttaatgggggcgttgtcatcgtcggtgaacgtgcgcgaatcacgtacgcttttcgaagaagcgcaagtttcgcgtgagtcgatgaccaagctagctcaagcaatcgatgtagagcagcgcgccatatccacgtacgagggagatgtagatgctgcagaagaccagttactaaagttgagagctaaaaccatgacatcattgtacgatcctactgcgctcctactgtcctcacttggtgtgaaattacctgaggcatacgatgctctgactgtcaaagatatgaagacgattaaagatgcacttcaaagcgacgtgatgggctacctatcgccactcactggtgtccagggtggcagtacgacgatggagcgcgcaatgtttccaaaggtgagttctgtattcgctccatccatagaggcggacttcgcggaattcaaatcgaccgaagcgtccaggataattcaactagtatataaacttgcgctcgaaatggaacaactaaggaatcaatctggttcggatttccaaagagcgacaagggtgtacgatctttcaaacgattccgtgattgtaacgtctaatcctttacaaagggaggttcacttacttaatcttatttctctcgctggttatgaccccgagcgctgggcacaggcatttggagtaccgataagtggaattggaaaacaaatactgagtgcttggggtaatggtagcaaaggaccactgaagcctgaagatattcgtaatatatttagaggtgaccgtgataaattgccttatgatctagactacacgtcgttgagttacgcctcaagggtcgctgaactcaaatcaattaacaaggatgttaggcttacctctcgtaatgagggcgaacctaacgtgaccttcaatattgaggatgaggcggaacgcgatgatgagcatctcgaagcataaagtgatatcctaatttttcacaaatgaaacatc

SEQ ID NO: 133 - DNA, 2439 bp, Unknown
  derived from dsRNAs of unknown virus
gaataatgagtgcctaagtagaaataattaaaatagtgtggcagtacattccagcggaggtcaaatacaagaagctcgtgcttccaagttagtccttcgggatgcagtccacaactataactgaagttatcactgatgttgagccagtactgcggctgagaggtcgatcacgggtggagcgagtgcgtaatgcttttatgcgcatgagcttaatctttgagcaggaaaattttgacgtcgacgaggtactggctttagcgtacgctaaagctaacttatcagatagacagaagcatcttttaagagaactggtggcgtcaggagagctgttttctcgagtgcctgatctcggttcaagagtagcgaccttctcaataaacccgagcactggaataccgaggaagccattactagcggaacgggcgcgtcgtgctctgatacgtgccgaacgagtatgggacaacatgatggaggacgtccgttcaaacaaattcctagcagagcaagcggatatggaggacggcagattcacgtatcgtacattaatgggggcgcgttttcccaaattagtgtctaagagtgagcttgatttaatgggcgaaggggatgccactgaagacgtgagcattcacactgagtttagtggttggtctggcattacaaagtttaaatcatattcaatgccttcggacgcgctttattcttcaagtgcagaagactcgaacatgatatatggcggtcgcatgataatggccaaattccatagtagtggattacaagtcaggggtcatgcaatgaaacgtctacgttcgtacggttatgatagcgagatgataacgctgaagtcgaacattgtggaagctgttatctctagcgggaggtctgtgccaaactggtcaatggagcgccctaagccctcaacgcgtaaagtgtcttacaaaataacttttgaattacttaacgttgaagttaaactatcatctaacgcggctagcgtttgcaagcttatcattagtggctacgtctttccgtcacttgataagcgtacagtcacaatgtccgagttcttagagtctggttctaataccttagatatcatagatccgttcgtggtcactgtcatcccattaacgatacccggatctaaatcgcgtcttcgtgccactggtatgcccgtcataccgtatgatgctgcgatcaaagacgttagtcctgcagtactcgctatcaaggctgaagattcccaagatgatagtgatgtcttaacttctacggtaaatgcaaacttacgtagaactgaccagtggttaaacattagtcatgatgaagttaagtcattctgttcggactcgcctcatcttgcaaggatgtatgaggacaataaatattcatacatcacaaagtgcggagtcgagttcgccgatgtggagtacattcgtgataactatccagttttattcgacgacctacttaacgttggacttgagatgcttacatcacaatccaacactacacgagaacctgaggcgctatcaaagcttgatgtttctgatgcgtggtcggagttctttgataaatcaagtggtccaagtattgttcattctgaagaaattcgatcacctaaccaggaagcgcagggagtgaaacctgtaacgtcttctctgctcttagtgagaattgtgctgtcacgcattttaattgttggaatcggtgaatcaacccatcgacccatgaacccagagatactaccaacgccgcatcacttaataaatcaaaaacgagccgaggccatgttaataccattaagtgtcatgaaggatggtttgttagtatataccctaactggttctgttggaagactactgaaagacgtaacccgcagcaatctatcaggtagcgtccttcataatatcatccgtggcagcgtaatatctggcgacgtacctacaaatattattgacgagttaacctcgcaatcactatttaaggtacgtgctcctattctaatggtgtcatcagagagcaaggctatgacagatctgtggtttgtagcgccatctggtatagaatttgatgtaacaccaatagcgatggaaatatgttctaaattatcagaggaaatgcttctaagcccgatcagccgatcggtattagcttggcatcccctgtttactatcgtggtgtccaaaacacttaaatcagatggctctttcaaatatgactcggttttgataccagcgaagagaaagtcatccattgccgtgtcctatcataacaccactgaggttatacgtgctactgactttaattctgaagtgaggatgcattacgcaacgatgagggagggagctggttatgtatcagccctgaaaacatatatctccggaattccttaaaatcattctatgcgaattaggttccacacactcaggaaacatc

SEQ ID NO: 134 - DNA, 3131 bp, Unknown
  derived from dsRNAs of unknown virus
agccatgcaggcaggcgtggctcccaatgccggggacggcttcaagaatatccaagcaattgacccgcttctagcgggaaacgaacgaactgtggcggtaaacgcggcgaagctggccgacttcaaagcgcgcttcaggatggatgtcaatctggagaccttcaacaagatctccggaacggccaaggtgaagagctggtacacaacgtggcagacccttgtccccaagcccgtggctatgcctcaggagtggatggatgtggaccttccccccaagatgtggacgatgatgaccgccgcgaaagagaatcggtcgctcgcccgtcgggtgtatcaggaagagatggcagaggcacaggagagatttcagaaagagaaggcccgtgtccaggcgaagctagatgcagctctcgcagacacttcgagcgactatgtgaggctgctggagtcgggattcaacgacctcagcgtaagcgacgtcgtcgcgatcgagtctgcacagtcgaaggagaagagagaggagctgctcgaagcaagactggtcactttgaggaagaggtggattgccctgatggaggcggggcagccgctccccgaataggggcgcgccaaccccgtgttaggggagccaaagccagttggggagaccgtagaaatcgtacgcggcctcctctacgactggttgaagcatcggcggaccatgctgtctgcagagtggctcccagaaccggcggcggaggtgcgggggataaagagaatgttgaggaagaaatgggagaggtggagggagtcagaggaagcggaggagtttatggagagggcgagagcaatgactgcgggtgcacgaaagaagatggcgagggaagaaatcatggtctacagggatcgcgcaagagcatcagcgcgtaccagaggcacgtctattctgatcaggtaccagaaggagctcgaggttggcattctggagaagtatttggtggggtcgttgagtgcggaggatgcggtagggtttgccgcgcgtggtttacagaggcgaagccaacggggtggggatgggcctgcgacgcaaattacagtgtccaggaggtatacaaggtggcgggccgacacggctggtacagtgcacacggagcaggtcatcaagactgctgtgctaggcccgaactctacacaattgtccaagcttcggtcacttgcgccgatggcaagccactctaccgcgtggctattgggccgaacgtatcaatgtgtaggggagcgccctgcaaagattgctggtcgcacgaacctcccgtccgcctttatccaaacgcgtggcacggaaggtgcgggcccagagaggatactggtacaccctggggtggagacaagctggacggacttggaatcgtgtatgttctcagaagcctctactgggacatcggcagatgttgtgtcgctgtgcctgaaaggaataagagggacgcattcttcctgggggttgcccagcataatggtggacccaatctcttcgacattccaacatggtatattcacgaagcctgctacaagcagtggttggggggaggacgccgatcagggccgcacaatgggatgctcagcttccttcgcagccgtgagactggaggagcggttccgcgcaatcatgcgcgagccagttccgaatacggctccgtgggtaattggtggaagggcgaagaggacggatattggtttggaggacaaggtactgaaggcgcgtgccgttgtgtacccgggggcggagagcaggctggtgtcgggcatgtattcacagtgggtgacgaggagttttgccgccagtcgtggaggcatttgggtcgggcgaaaattggattactcttcaaccgaggacctaagggcaaggtgtttgaaaggtctttggcagaggggggtcgactggaggcgttgtggtttcaatctcccggaactcctcgtcgtcgccggtttggcgtgtgccttcagcctgtttccccagacccgggagctcaggaatgtcttccttcacgaggcagcgggtgtggctgcaaagacggttctccttccaggaggctgggtctacaaagtcacaaagggctcgccttcgggaccgtggacaagcatcattgacacatttgccaacagcattatctttggctcatgttatgcgatgcttggtgttccacgttccccaccttttgagttctacggagacgacagcgtagaacacattacaccgggaaagtctaaaccctactcgcagctccgcgacaaggcccaggagttgtggggaatgaagggcgatgaagaggcggaggaaggcgaactctacacccaagacgagtccgatgccaagtgcacatttctgaagcggtacttctactgcgatgtgccaacgcgcaaggtgtcggcctggagggatgtgtctgagctcccagaaagaaagagagattcccccgaaagtcagctagaacgaatcgtttatgtcaagaacgagcctatgccgaatccagaggctcacaactacttcaaagactacttccagtacgttggagacacactgggactaatacggcgagatgtagccgccgcattcgaacagaactgttcccaggccgttgcccgcttctacgaagcgggcaagggcatagtcctccagccggaccgggagggaaagatgacgctaaggcaactccggtacactcacagccggttagttgcctgggcactcgagcgatcaccaaatggtgaacttagatgcccaaatatctggagatcctttgcgtggagggtcggcgcaagcccatacttccccggcttttgcagttactcaggatgcacaccatctcggtgggcagacaacttccggcaaccctactttgacaagcgtacaaagaggcaagtcagaagtatctgctcccaactggtggacaactggggccgcaaggccagggactgggcccagccgggcaaccccaaacggaaaccagcttacctgtgagacgaggcgcaactagggcaggcccccataacggccaccgcccagctgcgcgcctccacctccggagccgccgcgaccagcgagacgcggcgcccggaaggccgcctggccacggacgcagcccgtggtatca

SEQ ID NO: 135 - DNA, 1518 bp, Unknown
  derived from dsRNAs of unknown virus
gaatagaaatcccttcccacgatagagaatatggaatatccgctagattttagagtaagttcacgtccacgtgatggcttcaggtcggcgagtgctccatatattttgaaaggtttgtcaaaggaatcaatctcacgtttagaggtagacgaaaagcttattgaatcggaactggatgatgctgatttcgttgcacgacgtgatgagctggctagacgaatgagaatttcacctaacatgattaagaccgaacttggcgatctgttctatgaactaaatgagctgattcatccaggtacattagatctaacagagctgaagaagtcgaaaggaaagcttgatttacaatcaatcatatgcacgaagctgtcacgtgatcaacacgaattatcatatcataacattctatttgatgtatataacagccgtgatccaactgtgaaatacaccagaccgtcactattacatcgcgaccataataataggctccagttaattgaaggatcgaggatgctgaattacatgtatgaaccggctgacatctcacgtattacggtgcctattaagtttagactgcataacgatgacgatgcaattattctaatttcaactgtaacgatgagagaggaccatatgactgtagccattaacgttgatgttgaagatgaccacatatcagatttgatggacggtctcaaatccacgactcatataacgtacggtgctaataatgtagtggctccattcgtactcgagagcatggggcttgaaaacggcacaatcgtattgcacgtgtttcataaaacggatggtagtgcactggctagctggatgaagtggtgctcagaaatgtttgagcgcatgctttcatcaattgttaatactttaagatcaagtacgcaagcatacttcgcccctggtcttggagggcagctgccagttgatttcttcagagcgctacgaggtaccatagctgctattaacgacgaaaaacatctggagcgcgtgagtgatagagtcataattggtgaactgatcatggcgcatgctaaggctacgggagagaaactaaacgagaagcgaatggagcgcgtctttgtgtcatcttcccacctacaggaattcctaaaatctttcttaatattcgtcaaatccttcgacgcgttcaacaagatcgcgcaatataacaagcgtgatgacagaggagcctttaaaccgttttctgaaagacttgaaatttcgaatatggtaatgcgattgaacaaagatagtgtgggcatgtcctcaatgctagcatcgaatgcagcatttgctgaaagagcccttcaaactatacgtaacagtgcaacatatgataacatcaagttactatcagaattaattgacgcccagatcgcagacataaaaacttacatgtgatccagcgatggtccaatttctcacgggtaacgaaatggcttgacacacctctacattacacctatagtggggccggccgcggcaaaggatggtaacatc

SEQ ID NO: 136 - DNA, 1333 bp, Unknown
  derived from dsRNAs of unknown virus
gaatattacacgcagtagtaaatactggtgtgcatagttaatgtttgtactttatcttccatacggtgaggaaaaagttgtgatttgtggagtgccattagatttgtgtctatacatttttagacatatattcaaggtggcaaaaggcgtgcacccaagtttatataatcacgagaaccctacggcattcaacccacttaattcgtgggtacgtggaaccgtaaaagagaaaatcgagactacaataaggactgtgactggtggagttgcgctcttaaacccagacttcgttccaaaattgaagtcaatatactcggaagcaatcataaacgactgcagagtaggttatctgtacctggattgggatcctacgttatcatacgctagtcatatagacgaacactcagtattggctggcatatacgataaagactcgttcgtaactgaggtaattagaggcttacgaaatcattcagtgccatcgaaactacctcaaccatccattgaggaatttttgaaggtatctatagatagtgaacttcgcaatactcctggacttaagccattaacaaggcgtgcactaacagcagagtccctggccatacaaaagaaatatagcgacttcctgtggaagcaatgacagaacatgattggagcagttatgagccaacgctagtacgcattaagcatagctgttttgctatgcacgcattatataggaagcggtacctattatcccgcgagcgagtaatatattacgatgtgccaatcatagtactgtcagcgatgactagcgtattcattgctggagcggaagaatggttaaatgcatcaattgtgaaggtactgacgtgcgtcacgtctttgattgttggcgtacttggggcattaaagaaattcttcaagattgatgaaaacagagaaagttgcttagaaacgtataaggatatgtttcgcctattctgtgagctatccatgatgctggatcagccgcctgattctagaggcgtcgatgcacaaaaatactcaacggaattggctaatagatactctgaaataatggatcgggctatagtgttggaagatgcaaggacgatggagaaccctatatataacgataaggctaatatgccctctaagctacggaaacgattttctaagtcgttcaaggagctaccacctgcaccggaaactccaccggcaagacatacccacgccgaggaggaatcgtacgcataactgacacacacctcactgatgtcgacagtgatgaattactgctaccatgtagagaatatcctcatggtggtcatgtcagcgtgtatgaaacatc

SEQ ID NO: 137 - DNA, 3472 bp, Unknown
  derived from dsRNAs of unknown virus
gaatattattggaagaatcttaagtacagatgtcgcaaaccgacgagcaatataaaggtaaactaccacgcccggcaaaaactcaaagtatcaaagagtttgaagatgaggaaataaaaccagatcctgagtacactgaatttaactcggttgcagagatcctggctaaacctgaatactttaagcttataattgagcagcccgaattccaagccatgcttaagcgcgaaggcgtcccaaacccattatctaaaacagatgatgaatcgggaggcgtcgaacctaagtcgggagagaaaaagggagagcaaaaggagaagaaagtcgaggcagaacctgatggctctaaagcagatgctgaaggagatgaaccaaaaacgtctattgatgtagtcatggtaccctcattagaggaggtggcgccagtaatggatgatactacctcgccggaaccttcggcacctagcacgtttgaaccaagttacaggcgtgtgactcataaagtcacggcccccgttgacatagatgtgacgcacgatctggccatcctgacgaagtcaggtattgaagacttattggttgattacagtggtgataggactacaaagaaaggagctaagtttcatgcattccttcaacagtttcgtcccatggcacaaatcgagcctctttcttatgatgagacaactggctctgttaagatgtcaaaccacgcattcgtgtttggtgaatcggtgtctgggaaaagctctaaggcgcacgagtatgagcttggccgtgttaggcctaagattgccactagttccgagggaacgttacagcgtttaaaagctgacatggcgatgcctgaagagctgacgaactctgtgggtcctggggagctcattgatcttgcgcttgagccgcgtacgacaggcataaaggtgaaaagcgcagatgtgatcatgaaccctgcccgccttcctcttatgttgagagatactatggctttcaggtctatgaccatgagttaccctgattggcttgccgctcatggtcaattcatcaacccaaaaatgctgtcgtatgttcgtgagaagaacgccaaagagagggatgtcattacgaacacgtacttgaagagatcaatgtacgatcgtttcgtcctcggtgacatggcgaacaacagccaaagctactatttcgatgaactccccaactcgcgtaactaccagatatgtgagggcgttttgaaccgatcgctgtcaaaagcgatggaggccatgtcgaccttatcgtcgtcacagagatcaatcagcactaacatcactaacaggcaggcatctcaaatgctactcggcatgacatcaattcagcctagtgatggagtcaactttgccaggcatttaggtgcatacttgcttggtggaaagcgtcggactcttgaagtcgatatcgatgatggagctacaaaaacgccgttacttaacgcattgtgctcttttgctaaccttgtgctaattgatcggcgcttccttgacgatcgaagctacaggcaactagtggtgaacgtactcctgcctttctacgatgaattttcaattcagcgtatgaacgatgccacaaagagagtggagcgttctcgtgacgttcatgacatcgcgaacgatctagtggcaggaagaattgatctccccaaagtgacgaagatggtagataccactggcaggggatcgtccaaagccagagagattaaaatcatattgacaaacctgtttgcccgcgttatgagtatcgagtactcgcagctaaacgccactgggcgcatgtttgaaacccccgccggggcgccattcacgccattcacgcctcgtggggatatcgttgacgttgttctatttggaaccagaactgatggatttgaatcacgtatgcatgaacttgtttcgtacaagcctgaggcgctcaagttgagtacgctagttgaggagtacgcagatgtgcttggtaagctgcgacagttcgatggaattggtcttgctatgtccgaggcgatgaagacgaagacgcatgtcaccaagtcaatggcaattttcactgatgcattcatccacggctctacgcacactgaattgctgccgccaggggagcggatcgccgatgtgagatctattgacacggttatgctcccattcgatggtgctctgtcctttctgttatatggaattggatcttctgagattgcagaaactactgacgcatttgttcgcttcaaatcgatgtctgcgcctgtattgccttctctctaccctgtttatttgtacgttgagcgcgccattgttcagcaagcatttaacgaattctctacggagccaaccccgtatcttatcacccatcgcgaaatggtgatcgatgtatgcgtggacgctctaaaggtgtatttcacaagcgtggatcccgattcacgtgggcgcatctcgcatatgtttgatgactcagacaagctggaacgttcagccgactttgacttacctaccctgcttacatctaaattgtttaacgatcacgaattcacgccgatggttggttcggaaggccaaaaacagctgcctggatcttttgatactaatgcagatatcgcagagaagaacaaggacatcaactcgtacacgagcgctcttaaagccacagaccgcgtagtggagcaggtgtttattgattttgaacctatttcgccaacgaagatagagacgtattccagcggaagtacccttgtgtataccggaaagcgtgataagtctcaatatatctcattgtcagaaatagttactaaggcgctatacattgactccgacactttgtcggttgatgccattcgcaatcttgcgaaagcgcatattaggcgagagcaggagatttatgggaatacgacaattttaggcgtctacattgatgacgttcgtacctcgttcaagtttgtcgagcataagggattaagtgatatcgttgtggatacaccaaccatcacgatcgatcgcaattccaggtaccttgacactcagttcgaagtgagtgaaattagcgtgtactaccatcgcctgacagatagacagggtgagttaagcaacgctgtgattatgcgggaactcgaatacctcaatggtttcttgacatacgtctcgattgatcaggatactatccagaagtgccttgttaacttcgatcatgccgaccccatgaacccttctatctataagttaggtccagatggctcacgcgtgagcgaagactcaattgctgccattaaattgagagacggacgtggtgttacctacgctggtcgtgtgactctgtctactagagaatctgaagaaattgagataattaaacagcttagttcgaaagagagcttcgtaccctaataatctgaaatttcgcaatggggtaaagattccatgtaataaaattctatacggatccaatatgaaacatc

SEQ ID NO: 138 - DNA, 1403 bp, Unknown
  derived from dsRNAs of unknown virus
gaatattgtttgtgttaaaaagcatgagtgaagcaggaagttctgaggtaatgagtgaatcaacacagggagcagctggagggggctttaaaagcaaaaagagtgcgccatcaggtgggcgcaaacttacgaagaggaagccttcatctaaatctactgaattaaatttgaaaggagtcgctgttgtagacggtccatcatctggtaatttgggtcatatcgctgatgcagcaatgagtgatgtcaagaatcccctagaagaattcaaggaaatgctggggggcaaaaggtatagcccagttgcattcagatgcgtggtgtcaaaagctggagaaatcctgaaagagaacccacaagcgaaagcgattgtagaacagatcacgagacaagagcacaatctcaaggtcctgattactattaaagaacaggatactgagcttgaaaagaagcagcgcaaggatcagcaggaggcggaggaaaagaaagctaagatacagcttgagcttgtaaaagcactcgacaaagacgatcttgaggctaaactaatccagcttgataatgtaatgcgtcttatgcaagaacaacacgcaaatactttacaaagtttgcagacagttgcaagaggtattatggaaaagagattggagttgcagcagctacaacgatccttcgttatgcaagagtcagcgttcataaagtttgcgcgttcagtggacagtcctagcgatatgaccctaacattagagcaggctaaggaagtcgaagcgcagatcaataaggtggcgaaacgtccttttgatatcagtattgaggactgcgttgcaccagcgattgtaagcggcatagatggtgatggcataactgacgagaaagcgatattagctgcgatatacgaaacgtttgccctcaaattcctcggtggtggttatacgacgtaccttagcggaaagatcatttccgacgtcgataaaatgactgcaaggatgggatccagatacgcagcaatcaacaaagatggttatgagtttctgtcccagaaggaaaagcgtgataggttacttaatcgtagtgaaataacttacgtagataatcccttagtcactatactaaaacaactaaacgctatcgttcgtgccggtcttgacgtcccgcttgtgacatcgtatttaggagtacctgttagcggagcagtggaaactatttataagaagtgggcatcatataaaggacagcgtgtgttgaattccttggatctatttgacttatttgaaccaatattaatctatggaggattgagcttaaacagctcctctctaacagaaattgagaaacaggtgtttaggtcaattggaagcaaccaagatgaagaagattaatacatagcaacacaacatgaaaacatc

SEQ ID NO: 139 - DNA, 4748 bp, Unknown
  derived from dsRNAs of unknown virus
gaagtcttatccatatgttcaaaccgggtggcgtgcggcaagtgcctccattgaggtccgcgctgcacgtcaccgaagtcaatgcacgtatagatggtatactgcggcagctgaaagaggagtacagcgacccgttcagttatacgatcagcacgagcgcccccacgaatggcgccagaaatgcaggcgtgcgcaaagggcgcttccgccgacgtcgcgctgcggctgtatccaagttgaaaatcgaggtggcgctgaagcttcttgagcgcttcccgatcgacgacgagtcacaggcgtatattattgacgttatccgaaagatgggcgaggccgatagcgacccggacctcaacgcattcggtttgtacaccacaggcgtgtcgatgcatgtgtttggccgacccgtagttcttggcgtgccggcgctggactggatacgtgcgcggggtatcaacccgggcaaaagcgcgttcgcgtgcgatgtcgcgcgcgtcgacggcgtggaagtctccgtcaacaagagcgcgaaaaccgtatctatacgcatcggcagcgacgacctcacggtttcgtttgagccacagcctgcctgtcgagttccgggagccgcgagcgtgggctgcactgatgcgcccagagcgatcattgcgcctgtcgctaagaatacgaccaaggcggtcgacctgcgcgggctcgtggacgacggcttgagtacgagtgccgcgggcggacgtgtcgtcctactcgactcggtcgaggaggccaggctaatcagcgcggaagtagaagcgtcggtcggcgtcaaggtcaagggtgtgaggcagttcgcaagcatcgaagaggcgtatgcgcacgtcgcgatgcctatcgaggagtacgcgattgatgcagggctgggtgcgtcctacaccgctctacataagggcggtcgcctgaagcagtacgcggatgtcaatttctacgacgcgttcaaagctgtactcgccgtggagctgaaccgagggcggcccgaggagattcccgaggcacgtcggtgtgcgttgtggctcataggtgtgttaatcgtggccccgtggcacgccacgtctgatgggcgcgccagcgccacgccacaggacctggtcagaggttggctgaacggtcgcaaggtgggcgcggagtggctcgcgccgatggcgaaggcgtccgagcggacgtcatatgccgacgagccattcacgatcggcgagcgaggtgagtcagtcaccgacgaactaacgggtcgaacgtttagcgcgaattcgcttggtgcgtccgttaatgcggtacgtgcgacgcagatgacggagatcttgcgagcggaaaaggttctggactcaagagggaatgtgctgcccgggaaagctgccgctaagcgtgaactcgacaagagtctgggcgcagaagaccgtgtgcccgtgctattctcatcaaagggcgagatcttcaccggggcggcgagtgcgttacacgccgtgcgcatgcagtggtttctctcgatgtatagggcgtactcatatgatatgcaccccgacgcgccatgggtacagctagactttacttcgcgtctcgcgatcgggggtcgcaggtggttctcgaaggttaagggagccggcgcggcgactttgcgttatgtgcaggcgtctatgggcgtgactccgaggatcgtggcggacagaagcgatggtgtaatggcggatcgtgacagggtgtatgagttgcacgaagatactcctgcgctggtatcgcacgccgttcggatggatcccgacaaacaggatccggctgtgtacagaaacgcgggctggcggaacgaactccgggacatcatcgttgagatagcagcgaaatggagcccgcgaatgctcgacatggcgctcgacctgcggaagcagttgcgcgaatccgacggcacgctcgaaaccgaagttaggaatcaggacgcgctgaacaaccttctccgcgcctttgcgtggatgcagcgccccgcctgggtgggattcgccacgcccgacgcgtgcagcggcctcggcacgtacccgacaacggcgacgatcgagcacgtggaggggtcgaacgtcgattcggagaacttcagacggttcttcgcgcgcgagatgctggacatagcacacgagcccctgacgaagatggacatgtatcgtctagggaagggtacctcgtccggaccgggcactagcgtcctaatacgtccgtctggcggagtgatcaagctgggggcgggcgtcgttcgtgacgaccggatcgaggtgagtcgcgtcaagatgcaggttaagcgtgtagtgatgtccgcaaacggcgatttacttgcggacgagtgggtcgactccatccgcgaaatcggcactgtacgccgaccgaacaccgttgggcgccgcgacgacgtcgggaaggaggttcgctacatctacatcatcttcctgcctgtgctcctcctacagcttatggtcaataagtcgttcgagacatacgagaaagatcctcgcttcgcctccgtgttttcgaacgtccataccgaaggagtgttcggtagggacgtggcacgcatgatcggaaagatccacgaggcgaacaagaagtgggaatcgctgattgagaagatcctcgttcacgagcgcgactttccgaggtgggacggccatatcaccgccgcgctggcggtcataatgcagatggcgaacgacgctgaaggcatgttctcgtcgtggacggaacgcaaccgatcgttgctcgcagcgaccttgctgccgtatgtcgagggccgcgcggtctttcaggtctcggatcttgattccgacatcttcgtgttgctgctgaactcgatgtcgtcgggcgacgcgtggacgtccaagctgggttcgttagttaacagagttctgtttaacgtgacgaacgagttctacgctaagttctccagtgcgggagccggcgaccggacggggtggatgcgggagttcgagtgggagacgaatcctcggccgttcgtaccccgcgccaagcccttcacggtgaacggcgacgcgtcgaccgcacaggtctttggcgacgacgcgctcgagctgctgaagctgcagatcggtggtgcgaccggtcatgagtacgagcggatgattgcggatctaatcttccttacgtcatgggcaattcgacagtcgggtttcggaacgaaccctgacgatctgcaagcgacggatgccgcggcgtcgtttcttaacgtttacggttggggcgacgcgatttggcgtcgctcgcgcgggatcggcgtgactgagaaggagggcaagaagtctgtgacggatcaagtgtcggcgttcggtggtgccgtcatgtcaggcatgtcgatatacgggtacacagtgaacacactcgttgcgatactgaccggcgaggaggcctccgcgttcggatacgtcgctgaggtgtcggtgtacacgtatctgcgcccgagcgaagagcaggcgttcgtcaccatgcttccctacccgcgggctccctttctgatgtacatggcgctcggcgagcacctgctccccgaaaatcacgtcgacatttcgacgctcgcgaagataagtgacaaagcagcgctggccgccgaggacgtcgtaaagaggggtaggatgtccggccagtatttgtacaacgatcaggggcccttggcgattgagcctgcgacacagctggcttcggacacgtacatagatgaggggcgcatggatgacgcgatggcagcaatcgataccctaaaaacgttgacagcggatgagcgtgagcaaatgctggacaggcagatgaagcacgcgctaacgagcggtatagcagacaaactcgcgacggacacccaggtagggccgtctctgaggctagcgtcggcgattgactcgacggtaagaagcgagtcgatgattcccgacaagcaagtcaccgttggtgagcgcatcctcgagtttacggacgaaagagtgtacaatctcgtgacggccggcaacgggcagttatgggtgctcgacgccgacaatcgacagatgggtcggaacgcgatacccttcctcggaacagtagtgaattccgcatcgccggagttcttggtcatgcaggctatcttcggcatcgctatggagaaagagcggtcgttgtccaagcttccggacacgggctcattctctccaaatacgataccaggctcgaccgctctgggctgggcgcgcgactatagtacgagggtcaaggggggatacgacgatactgtcgccttcctgcgcggcatgggccacgatgcggggaccgcggcgaggatggccacgttgcggaatgacctacgctttacgcgaatcgtggaagacatggaagagtggaagagttcccgagttcccgagatgtcgttgtctatacgccgattcgaagagctaattcgtcctatggtcgagaaagagattgtttctgatgatctgccaggcgaaccagcgtacttcgcgtcggagctaatcggcgtcgttaccgaagccatcgccgcgatcaccgtcaattcgactctgatgaatatcactgcctacatggaccgtcagcgcagtgccgcagcttcccctagcgttgcagacttctataccagacccgggatacacctcggttcggtctacaaagtacgtagtacagtacgtagccgttccaaggcataacttgaacagtgtgagcggatggagtcaaagatc

SEQ ID NO: 140 - DNA, 2260 bp, Unknown
  derived from dsRNAs of unknown virus
gaagtttttcccccattaatgagttcgactactcagacgcgtgcagacgcccgtaccaacagagcgacggagaaggagcatgcgactgtgatttcgagtgcgagcattgcaaccgcgcttaggcgtaggactcacgtggacgacggcgcggattttcggacggaactgtctgatgagcaatgcgccgccgtgtacgcggcgacgaacagtggtttattttcgtcgagtttcgaaccgaggagcagccttcgcggtcgtgcggcacgtgcgacgctggagacgaatgttgccgctgtgacggaagtcttggaggagatggaacgacgtggcggagtgctaaaagtgcgccgaatgatggctaactcgaaggtcggaaacgtaatacatacggcgaaggcgaaacagctgaagccttttcaggcgaaggtgaaggtcattatgccgagggggcaggacgcggtcatgcgagcgaagaagagcagtgaagtggctctgggagcagtctcggtgcagcggttcgaggtgctgggattcagcggcactccgacgttcgataagaagacggagacgtcgggcaccgagcatgcgaccgaacgcgcgaaggcggcggtcctctcgctggcggagtacctacttcagtatgtgccacgaggtgagctggacttcggaaaaacaggtgtgtatgagggcgaagccgagaatgacgtgaaatttacggtgtcggtcgagccgcaatacctggcacccggtgtcatatcgattcgtgcgcgcatgatttttacgtccggcgtgttccgagtgaacgacgtctatgcgatcccgctcaacgggtacggttttatgcttggagcagaaatggctggaaaagcgcaggtggctggaaaagcgcattacgactatacacgcgtaatcacggtgttcatcggtggcctgcacgtggtctcgcaacaggcacgcgctctgcgtgccggcggggggatcgacttcgcgctgacacaactgggcaacgagctggtagcgattgtcggtgatgcggggcggacggtcaactcggcgaatctgtggagcggtatccctcccgtgtgttacacatcgctaaccttctttcagagcaggagcagaatgcgagttcagatcgtggaggagcaagatgtggcgcatcccttggggttagagaccgaccacctcgcgcggaccggcttagacccgtcgcacccgcttcgcgatgcacattggcgtaccaccgcgcgcgtgaacccgagcatactggtcgctgccaacgcgttctaccgtggcgtcggcatggagctctggggctatagtgatagtcgcacgacatccgcgctgcgacaatggctggccaaccacctgactctcgtcacgactgacgccggcacggtcatgaaacccgccttggcggatgatcctttggagcaggaaataaacgtggataggatcgtcgcagccttggaggtgtcgacgaagtttcaacaggtcgtgcgtaatgcgcgcctcggctcggaaactattcgcgtcggtttgctgtaccccaagacgaatgtcgagttctcacaggtgcccccgatgctcgtgccgacagccggcgaagaagcgcggctgtttgtgtcaggcatcagcggcggtgcgatgaggtacttcgacacgtacgtccccgatcctgcgaataacgggaaaagcatatccgcctggaagctgctatcgcgctttaggcagaaggggagcttttccaacgccacggaattcgagcgatatgcgtacatcgatccagatgacgtggcacgcccacgcgcgctcggcacgctcgaggaaggcttcctcctggaggagaaggtggctaatggcgtgcaatatgtcgggtacggatcgcagtgcatcgatatctccgctgtggtatatggcatagcgaaccgcttgcacgagcggcggtcgcagggcttggacatttcccaagcgatgtgccgcaccttctttggcactatcggcgtagtcgcacatataagcgagagtgacgagggacgagccgacgcggtctacggctgcgtcgtgtcgccgtcatcgcgatcttcatcggttacacaggagcatgcgacgattccgggttcgtcgcgcaacgtggcagggcgagtagtgcgccgcatagccggcgcgctacactctgaagtgtctgattcgtgtgaactctatctcaacgccttgcgcggcgaagagtgatggaatacggcgcgggaaaaagtggatc

SEQ ID NO: 141 - DNA, 867 bp, Unknown
  derived from dsRNAs of unknown virus
ggagaaaaacgagagtagaagtctcccccggttaaatatgagcaaagtcaatagacgaggaaaaggtgataaccttccaaatgtttatcaggaggattttctggcccaaatagacagattcttcaatgatgtgagttggacatactcaccattggtgcaacttcattttgtcaaagctcttgacgaagttaactcggcagggtttaagcggaaacaggtacaccaatatctgaaaatacgcggcacccatggcaatgacgtagtgttcgctggtgacgcagagtttgatgtcaccgacaagtctaagaagatagttaacatagtctggcaaagcttctgtaagaacaaacacatagaagagtcattgagccgtaagatatcagatgaagaatgtgcaatagataatattgatgcagtccatgatgacgtcaaagaattccttagctatagataccctcagggctataacctgacttttgtccaaaggtccaaaactgacaaagacctgatcgacagagatgccaccgagcgatttgcttcactcccgcctgaatcacagcagttgcaagtgagtaccatcaatgatggtggcgggggtgataaatggaagttgcgtgtaggtaattacacaagcacgcactccagcaaaaagatggcaaggagactggtcatattgagctatgtgaacgatatgcccgaactccacaccacgaaatccggacagtaactggacgagtggagtgatgtcgtctactttctagagtgctagaactacccgggtctagcaatgtgtctcttcagtacattaattaactcaaatacatacggatgttgagtttaattcatatactgaagatgcccaccccc

SEQ ID NO: 142 - DNA, 1333 bp, Unknown
  derived from dsRNAs of unknown virus
gaatattacacgcagtagtaagtactggtgtgcatagttcatgtttgtattatatcttccctacggtaaggaggaagttgtaatctgtggaataccactagacgtttgtttgtacgtgtttaagcacatatttaaagtagcaactggtgtacatccaagcctatataaccacgacgatccgacagcgtttaatccattaaattcttggctacgtggagtagtgaaggagaaaattgaaacgacaattagaacgattactggtggagttgcacttttaaacccagagttcgttcctaaattgaagtccctttactccgaggcaatcattaacgactgtcgagttggttatttatacttggactgggacccaacgctatcatacgcaaaccatatcgacgagcattctgtgctcgctggggtatacgataaagattcattcgcacaagtcgtcataaaaggcttacggaatcacgcgataccatcaaggttacccataccttcgattgaagaattcctgaaggtttcaattgatagcgagttacgcaacacccccggattaaaaccacttacaaggcgcgcattaacagcggaatctcttgaaatacagaagaagtacagtgatttcgcgtggaagcaatgaccgatcatgagtggagtagttatgaaccaacgttaatacgtataaagcatagctgctttgctatgcatgctttgtatcgtaaacgatatctactatctcgtgaacgtgtgatattctatgatgtgccgatcatagttctatcagcgatgacgagtgtatttattgcaggggcggaggaatggttaaacgcatcgttagttaagatactaacatgtattacatcgttaattgtcggaatacttggtgcattaaagaaattctttaagatcgatgagaacagagaaagctgtttagagacatacaaagatatgttcagattgttctgtgaactatcgatgatgttggaccagcctcctgaggcgcggggcgttgacgcgcagaaatattccacagagcttgccaataggtattcggaaattatggaccgcgctatagttctagaggacgcaaggacaatggaaaaccctatttataatgataaggctaacatgccctctaagatgcggaagaggttctctcgttcttttaaggaactccctccagcgcccgaatccccaccaccaccacatgaccgtaacgtggaggaatcgtacgcgtaactatcacacacctcactgatgtcgacagtgatgaattgctgctgccatattgagaatatcaatgtgacggccatgcctgcgtgtatgaaacatc

SEQ ID NO: 143 - DNA, 1576 bp, Unknown
  derived from dsRNAs of unknown virus
gaatattgtagcgctgtctatgtcataacatggatattgcgtatctatctcgatacagtgatggtgttaaaacaaagcaacctacattaaagttactcaaaacgaggcagaggtccatgctcggagcgttcgtagtgactgatacgaagacgaacatagatccaaacgccctattgatgaagaaggataatgctaaaatcttcaccgtaagcatcacagatgtcagaaaattgatgtcacagaagaaatacagtgtggaaaaggcgttagcttattatgaagcggttacgcagatacctcatgctgataggaaattgctggcatataccaacagaaagcataatcctccatcaatcagtatgactaaggaagtaactaagctaccgcaaattgagtggtataacaactcatggataaataactcgtgggttaggaatatgatgcgcgaggacggaggccctccatgcttctggaccaaagactataccgccatgagcgatccatttagtaaatcatggaaactatatgatgagaagttccctgaccgcggatggagagtaacatatgacgtgtatgactcgatcgataaagttctttcccagctattggactttcttgagatgcataaagatgaggaagtagttcacgtgtggattcaaggaactttgaaaggaaaggatccaaagactgtgatctccgacttgaagcggggcttggacttcgccagtagtaaggagaacgaaggggagttgtatgataacaacacggtaaccagaggcaagcgtacagccgagtatcttgaactgtggaacacgccgttggagtcctcaattgacacgtgggattattacggaggtaaaagtcccgtgcgaataccagtgataccctggcgtgtatccaatctggggcctcgcgtgtactctaagtccatccctccgcaactattcccgccaacccattttgcgaaagctatgaacatgcctgaacttaagttaaatctaactgaagtgtactgcaactatagtgaatttgtagaaatggtgcccataacctcagacgatgccttaatgttagattatggctggatgcccgttggaaacaacttatataccatggcgaagatatctgactcaactcgaggccatttgctaaaagtcaaagacccagatttcttcaatggatgtgggtccgttgtaactgcggcacatgcttgctttggaattgggagatcgaatgtcgatcttataaatcaacttgaacgaaagctgaacactggtcacagcacatcaggacacatgatcgctagcgtcctcgctttccaaagccaattcctttggtatctacaggaagtgtttgataactttgagaaaggtagtagcgtttacattaccaagttcgctgaacccggatctggtatgtaccactcgatatacgagtatagaaatgcaatccatgatatgaaaacggctgataaaagtaagctatatccaaactatgctagaaacaatttggacatatgtgagaaatttgtcagctcattgaagttatagatagggaacagcgcaacatgaacatc

SEQ ID NO: 144 - DNA, 898 bp, Unknown
  derived from dsRNAs of unknown virus
gaatattgactgaaactaaacaaacgaaccgagagaactaccgaacacggtggatagattgcaattgtataatggcccaggaacacatggacgacaatgcggaaatgacatggtcaccgttggacgtgactgacatatccaaggtcgcacaggaaatacgcatcgctcaacgtgttgtatccgcaaatatgaggcggattacaatcgatgacatggacggggcaaggcaaattgttactactgtagggaatattgttcaactaattcatgaaatggtgatgtcatgttcgatatacaaggctgactacacagctgagtataacgcgatggctatagtaacagatgagatccagtgcgcactctggacgttccaccagggcttgcttgatcatagattacgtatgcttgacttgcgacggaaatatgcacgagatcgagaacgcactgggctcagccttgagggtgttgagtcaggattcatgttgtctatgtacatagcgtcttatgaggcgatgatattggctacatgtgatactatgaaagcagcctcacagtggcaccacaacatggcgatcatgtcagactccattaatatggcggcatcatatgacgccgcagctgaattagataacgcggatttaaatgagtttgagcacgctgaagatgtcacggatccactcacggatggcgatgatcttggaccacttggcactttgcattcacacatggctaatagtgacctggcttcaagcgcaggtgaagtagccttaaacgttgaacaagtgtgcgaaataacgtcaactcccaaaagtcctattgatgtataattagtcacatcgtgtggtagcgaatcgggggtggtccccatacttgttgtttagtttcagcatggaacatc

SEQ ID NO: 145 - DNA, 1212 bp, Unknown
  derived from dsRNAs of unknown virus
gataaatttcagtaacaggtgagcatgggagacagcgtctctgatcgctcgggagctggtctccccctgagttctactttcggctataagattcttttgcagaaaaaggactacgatcatgatgccactgtacccgcagatgcgatctggacacctttcgagtctaatgaaaagtaccagaatgcagatacggatgcctacctcacgttttaccaaataggaacgaaggtatttctgaccctaacgaaagcatctcaagatgtggatcgtagtttacaccttactgtcacttggaccagaaatgggggaataggatttactgaagacagaggcggaatcattagttggctgcaattgttatctaagaccaactcagtggtgacgaaatcgccggtgattttagtgtgtgatgattttcaggggttatttgttctgcttccttgcaatttgaccgaggtgtaccaatgtggcgacttcgctgttagaaagaaggtcctgaaaccattagctgttctagctcgtttgttgaacattgtaccatctagcaaagaggagaacaacctttacattcataatatgctaaaggcacttcatctcagaagtgatgattccagagaattgattccttcggatggtggagcaagagtgttagcaccgtatctaaccgatgaagatactgcatctgtcatgcgtggcgcacttttaggattggaaccaggaggtaaggtgattcgttggtgtaatctactcgttgggtatgatttggatcagaccacggctgattattacttcgacaccctgaagatcgtgggagaaatgtggaagactccgagtacgccccagatagatgttgcatcctgggtccctcaatatgacgtgatggttcctctattacctactccgccgacagatcttacattgtatcaacagtgggtacatgaagcagaagagactgatcataatggcgcacttgtacgagctggcaagtatggaatacaacaaggattgttcactgcaaatgaacccttcattccccaatggttgaagaatctacttaattcctaaacgtcacattgaatgttggtcgtccgatgatctattaactatttattcatacatattatcgcattggagcgaaatatgcgacgagtctctgtgctttccacttagtgtgtccctgctaagtgtgactgttacgatagatcaacgatc

SEQ ID NO: 146 - DNA, 876 bp, Unknown
  derived from dsRNAs of unknown virus
gaatattcttgagcactaaccatgtccaacgtctacgcgcatagtgacaaattctatgatcctaaagacctagctgagggaagttttggtacaagtgttgataaataccttgggagaagtccattcgatgggccatctggctatgtatttagaaaaatacagtacactgcctcagctgacgcaagtaaaacgaacctagctggaatctataagactggtgtactacataggggccatatctaccatgatgccgagaacggaactgaaaatataatcaatgaagatcaagcaggtggaggaggcattacgggcgagtcaaagctgcaaccaggtgatatcgttctaggtgccatcctccaaattattgatggtagaggcgccgacaacagaactggcattatcactggtggcctcgtggctaatgacagctcgtcgcctgatacttatggacctgagatttctaatcaaaatggaacattcgtaatcggcagcgctatttctggcgcaaaatcaatgtcggcaggagagaagatgatgtcagtttgtacaccaaacttagatatctacaactccccacgtattagtacattatcaggagatctaggaccacaggatgtagccgcgcctctactcgcaattaatgtaagtggatgcacaggctcattctctagtcagataagatttgtattgcatgtgtatgcgttatgcggagcaagacagaaagcagtcagcgcgtataaagaacctgatatggagtttagccttagttgtttaacaaagaaggtggctcctcatcctgtttcgatagtctagaggaatggtcagtgtgatcgcagtatgtcaacgctgggttccacggtcacaagatgaaacatc

SEQ ID NO: 147 - DNA, 1933 bp, Unknown
  derived from dsRNAs of unknown virus
gaatattgttagctgttaagtgaaaatatctaatgagcttgttacattcggacggagtgagtagtagaattggcaaagtaaaacaaaagtttgcattaacctacaaacgtagtatggtgagcgcttgggtagtaggagataagacaactcttgatccagtggcgatcataatgtctaaagataacacccgagtgtttactattgattcaaaggagatgtcaaagatgggagaagataatgactacactttaggcaaaacaatagcgtatattgaaagtgtatctcaatcaccgctatatcgaccaggtttcataatacatgacaatgcgaagcatccacctccatttaacccaacacatgctcgtcacgtagcgtactcagaaatagctcgtgatgatagctacttcctgggaggaaagcgaggtatacatacgaaggaggagaagattaccttgatgcgcgagggcgtaccatattacgttgatggtgcagacccaagagatttctcagaaactgaactatcaaaggtgacgaaagggctatctgttcatggtatgaaaggagtattccaaggtaaggagtttgataattatgtcgataaccatgatctgtttgtagactatatctacgataagaaaggtaagaagtacattatccttagacatgatgaatccatgatgaatcacgctgctaaatcttttgctgatggtcaagagtcaccgcctcgcggtacacaccgattaggaggagatatgggtgttgatacgaagatattgtactttaataatacatggacagggaattcgtgggcaaagaacatcaatctacggggaggtggtgcgccatgtttctggactaagaattacagtgcaatagagcatcaagttgatagagattggatgcgatatgcagacaggtggccaggaagatcacgacgtgttgcatatgataagtataatacattcgacctcgtgatgaatgaattgagaaaattcttggtagagcacagttatgaaccagaagtacatatttggattcagggcgtcgtagaaggaatggatttcaatgttaccgtcgcgaaaattcgttccgagatcgagagcgatgacacgctgagggacgaaaccgttgatcaggactacatcatggcctacaaacgttattgggaaactgacctaatgtcatccttagacgtgtggtttaccaacgcatatagaaatccatctcgcatcgccacaatcccatggcgtacatgcacacacggaatgcgatcatatggaacaggactgaatccacaattatatccatcaacgaccttgcgcagagggatggatttaaacgtgcaagtggaaggatcagaattgtactcgaactacagcggatatgtcgaattagtgccattgacaaaatcggacatagaaaagctagatttcgcgtggttacaacaaggcaattcaaataacttcaggatgcgtatacctacagaagataactataaatcgctacttaaggtgaaagaccctaaattctttctaggattaggttcagtcgccataggtcagcatagttgctatggtatcgggcgtagcgccaaggatctatacgcgcaacacgagcgtaaagtgaaaactggacatggaacatcaggacacatgataactagtgttttatgcttcagatcacactttctatggtatctagaagagataatgtataataatgttaataaaaagtcaatctataacctccctttcaaggaaccggaaggaggtttataccactcaatccaagaatataaacatgcaatttacgatatggagaaactactcgagtctaagggcgtataccctaattacgtgctaggtaattatggcatatgcaaatcattcgttgaggcgttagaataactttggggagcagctgcatgaacatc

SEQ ID NO: 148 - DNA, 1159 bp, Unknown
  derived from dsRNAs of unknown virus
gggatttttctttactttgacatttcgtctgctgtttgtgtaatcgttgaacctgaaggttgacattcgtgatcatgaacgggaatattcggaatgaagagcaaagccaaaacctatgtgatggaatgattgtagcaaatacctttaggagtgcacagcttagatcgtttgttagtgcgatagtcggtatgaagtgtgtgaggatgcacccacttgagctggagccacgtgctaagtttttcaaaattgaggagtctcgtaaccttgcttgtcacatcctgaatgtaggcccatctccagtgcgtgattacttcattgccctgacttacgagttcgacatgtttggcaaggctcatcctggaatgtactgtttgtccgtcagatgtaggaacaagatggttgctcacatgttcaaccctgttacgactgatcagtttgtgaagtacgtcagaaatgagatagggatggttggggaatttgacttcgtcatcaggcaaggaagtgcgtactctgtgcgttacggtcaagtcaagccgcatttgccgccgcgtgtgcccatcttgttctacgcccagtcagctgttctatctgacatgtacatgatatacatgatgatgaggtacaactattaccagtatccgatagctggacagccactggagggaatcgaagatgtagtgtgaagcataatttgagtccacgttctgagttcgtgttcagagtctagaaactacagtaaattcataattcgagattaaaactcaaactcgacatttaaattgttaataataatggattaaactcaaaattcgagatttaaaattcaaactcaacatctaaattatcaataataatgaattaaatttcaattagctatttaaatgtttccaacatgtatcaattcatttaaatcttaattcaagagtcgaggttccatcattctttatctgttttgtattcagccattaaatcacttcaattaatcttgtcgcatgatcaaattatcatcataatcaggcgtcaattgattacacattagtaggacgataccgtcggtaatctccgctctcgcaccgggcggaagtatgtctatgcgacatcgcgcacatgcggatgtcgcctctaggcagcacctgcgggtctcaagttggaaacagac

SEQ ID NO: 149 - DNA, 834 bp, Unknown
  derived from dsRNAs of unknown virus
gaatattatctcatacacaatgtccacgtttagagtcgagcaacacgagctaaacgtgaacctgcgaacacgtgcagatttgtcgtctgcacgttgcgagatcacccatacaacagaagaagcgacaacaatgtcgatcgtagtaacaactgacaacgcaccatcaggaatcattgatgtgtcattcgttgatggcgtccccgtaattaaaattacaaaattaaagagtaatgtatttgaaatttcacatgcattagaaactcaaaatgtaattgaggatgccagcgaggatacagctagcataccagataatgacagtgaaattaccgacgcgactccaatcacaaatgtacgtactcttatgtcaccatcagatatatatcaagcacctgagctaaggcttgatacagattctacgccctcagagagagacagagctaacgagaggatatcagtaataactgaatcgttagcggcgtggaagatgaattttaaatctaatggtggaatgagtatacgtctgccagatggaagtgcgcgtagtttattcctgcgcgaagtacgtgaagaaatctcaggtatagatgttaaggatcagaagacctgtccaacattaataatgtctaaaacagtaccaaagaagggattgttacgtatcagcgatttacgcgacggtaaagagcttagagtaagtatgacacccattaagaatgggcaagtacagaaatactcagtagacgaaaccgatgccttacgatcagtgtacgaaaccttgaaaacgcaactataggggtaataatgggtgaatacgtgtattgaggtatgacaaacatc

SEQ ID NO: 150 - DNA, 826 bp, Unknown
  derived from dsRNAs of unknown virus
gaataattttagttttattaagtacataactaaaatagtgggacatcgccaaaatgtctaatgtattcacgccactcgccaagcaagctatagagtcgtccttaaaaacaattgatggactgcagacttttagaaagaaaggtgagaatttactagagcagttcgcctcacataatatcgcacagattttcatagaacgaatccccttgggaaaggttatgcaagctgtgatcgataaaatgtctggcggcaaactcaagaaattaatagaagaatcggactatgatactctatttcacctgcgagtactcttctaccttcatgacccgaatgatgatagcgttacgctagtatcagtcgaaaagaatgaaaaggtgacaatcacggttaatccaaagactgcaccggagggatcggaaagcttgcaaattggctcggcacccgtaaaatttgctcaggtaattggcatgactgcctcagccatgggcaagaaatttgacgggtattctgccaaagacaataattgtcaagattttgtaatagcaatgatgcatagaaactgggtctttcttaatcctgaacgggttacgctagatcaagtaaataagtttgttaagcaggatgcaaagtcagtgttctcctcaaataactacttaaggaagttcacaaacaccttaactgatattgcaggagccttgtcgccatttaacttcttaagcatgagctatgatgacaagtaggccatatagaccacagcagtgtgtctcacactggttttagttatggaattcagcctcatcttaatataaactactatgaaaacgtc

SEQ ID NO: 151 - DNA, 3276 bp, Unknown
  derived from dsRNAs of unknown virus
gggcatcaggatgtacttgggcgaagtgttctacaaaagagccggagcgtcagtgtatgcgatggttcaagagcagatcgatcagagtgagaagcaaatgcgaggagcatatacgcaagtagctccgtggtgtgtggtgtgccatggccaatatgagacaacgatagacaggcatggagagctaggtgcgataacgtgcggcaaaacgctatgctttgagaaatggcttgccaggtccggcggagcgtttgaaagctggtacttcagcggagtcggctcagtgcacgacctagttgacatgggggcagtgatgccacacatgaagctcacagagatgatacgagatgacatggtggcgaagaagtccaagcaaagcttctcgcactgtgacggctctatccgtgatctgtacgagagctttgagaaaagtggccctgtagaaattcgtgagtctggggtgatgctcagcgggatgggacaagaattcatgccgatggaccatgccctcatgctggcaaggtcggctatggctgagaataggcaaacgcccggcgcaggtgctgcatcactcggccaagggccagcagggttgtggcggaaacctgacttccttgacgatggcagcgtgcagacagccttggccatggaggacccagatcaggccaatgttgagatgtcgaaatggcgggatgcaacgaatttgaagctgggcgcagttaggcactggcaaatagagcccgatggagcaggccgtggctactgttatatgacggccgtgaatgagggtcagcagcacgtatacaagccaccgccaggctataggtcctatataatcgggcacatgtgccactatgtggacgggaagaagcgagcagaaccagtctgcaaatgctgcgcaatgggagatgattgccccataagcgacgatgcccacgcgtttggggtgaccaaggtgacgtgctcgccgaagtcagtgagtaagctggctgaaatggttctgctgaaaccggggtgtcgcggagtcatagcaaacgtgatggaggtcagaagcggcagagcagtgatagtagctatcgcacaggactgtgacgtgaaagacacggtcttgggtcgaatagaaggcactgaagcttcagtcaggaaggaggaccctctaggcacagtgctgttcccacaaaaggtcgggcattcgtccagctacaacgcgaagcgcttggcaaactccaggattgatgatggagtgaagatggcaagattgttgggaatgccgtcacagttcgggaagatgctgagggaagaaggggcctcgctgtcagtatcgaaccaacatgtggtgtggacggggaagacagtgttcagtacggcgagggcagtggcggcgatggacaagttgtctatcgaagtggacaaaagaagctcccagtcgcaggaggttggccagcggatagcaagggagcgtctgcgctcgacgattgcagcgcagcacggtcagttgaggatgctgtgccaattgaaactcgacaatgaggcgctattggacgcgaggctgaaggggagagacgaagacgacgacacctggtcactgctgtcagtccataactcgatcgcatcaggagtaacgagcgttggggtcagctcaatggggggcgtggacacgaacgaggcaagaatgttgcatctggaaggcgcgtacactgccgtttatgccaacgtagacgagatcaacgggctgttgggcagtagctgcaggttagtgagatcaggcgtagtgatacacatgcaagaagcaggcgatatgaatagcagctgggactcgacggtatcgctagagtactgtcagactgtgacgacactgcagaaggtgatcagccactcaccaatgggtcctaacttgcagccaatgtgttacgtaccgggcatgccagcgcttaaggtgaactcacagaggagcagtgagaccaagggtggcgtgaatgtcaagctgcggggctattacatatgcttcaggggcgacaacaacgttgacatggcggaaaagaatgaggacggagactacaaaatacagagcaagggccagttctggggtgtaacaggaaaaacagacccaaaggcgcatgtttcaggcaggtcatggaagacgaagcaagtatccacagcaaccgatatgggtgacgcgttctactttgcggttgcagagcaggacgtggggtgcactgctatgatgacgatgtggctaatcccagccgtgagagcaacacacgcatcaaggttgttcgatccagcgggcagcgaagaagagaagcattgccactatctagccctaaggagtagtgaagtgatagtagagagggagctgaaatatagcgagttcgtggcgagagtattgttcacagtcacgaaggaagacaaagtgttcgcagaccagtggcgaatggcgcagacgtcaggatcaatagtgccactgccaggcggaaggtgtggcctcttcacgcatgagaagctgctggaacactggccgaacggctgggccacgagtgcaaaacggcacctgctaaatgaggttagtgaggggcgcacgtggggagtggcgtgtggacacgaaagcagttttgcagcagcaggaatgtatgaagagtctggctcagacatcaacgacacggaagacagggatgaggagcaggccgaagagtgagcaaaccgggcaaacgcagaaaagcgcaagggccgaatgcatcaagggatataatgtagcgaaagagtgcccatgcaccatggttgagtgaaatgcatgggataattacatgcacgaggttagcacagatatagatggcggattggcgagcgtcaacccgcaaaaaggggggcaatagactgatagcagtcggtgagcctggttgcgagtgccgatgcaaagggggcatacgtgcaaattggagcacgctgcaggcaaccaaccagccgctcacagtacaggaagctttgggcataagagcgggcgtgtgatcaataataaaactaaaaccgcatggagcacgatgtggtgatgcgggaacagacgaatgactgcgacgcggccggacaccgacggtactacagtggaagcaagctctgacgacgcagaaaagcactaaggtgggctgaccgaaaaggagcgtcccgacgcgtagtgacagcagtaagtaataacaaccatgccataggacggcggcggcgaccaatgtagaggtacacattggcgtcggcagtcgaaaaagggcagcaggtagaaaaagacac

SEQ ID NO: 152 - DNA, 1017 bp, Unknown
  derived from dsRNAs of unknown virus
gaatattctctggcgcaatataccctataataaaatgctttatcacgcgaaacataacaaagagggaaacgatgaagttgaaatggagccgtcctacaccgcaaagtctaaaattccgatgctatacgacccaatggatttagctcgtggcagctatggaatccacgtcgacaagtatttagggaggagcccatgtgacggtcctgctgggtacatcttccaaaaggttacttacagtgccggtgccgtagcttcaaaaaccaatgtgggtggcatgtacaaagtgtgccctgatcatatgggcttcatttatcatgataatgagacgggtacggaagtgcgcattaacgcagatggcgcggatcttgcagggtcggacgatcctactccggccggcattagcggcgaagcgaagctggtgccgggtgatatgattctgggcgcgatcttacaacttgttgatacgaggtctgctgagaatagaactggattcgtaactgctggtctggtgtcgaacgattcggcaactcctgacacgtatggtcctgaactggccaatgatccttcaaactttatcacgggaagcgcgatcagtggaggtaagaccagcgctgctaatggcctagtgtcatgctcggtggcgagcccgaacttaaacatttatagcccagtcgtagtcgctactgcggcgtcggatttggcgcctgcagctgtcggtgcgccgattaacgctatcacagtgtctggcgtatcgccgccgagtacgtcgagccaaatcaggtttaatctgcatgtgtatgcattggtcggagctaggcagaaaactatctcccattacacgcagcctgatccttcgttcagaatggaatgccttacacgtcaatttgctgaacatccagtttccatgattcattaactcgatacgttaccgattatgtgataccatcatattgtaggcgtcatacagctccaaatgcggtcagtcaaaccgggttcacattacagagatgaaacatc

SEQ ID NO: 153 - DNA, 1240 bp, Unknown
  derived from dsRNAs of unknown virus
gggatttttcttgactgtaacgcttcatcgactgttgtgtgtccaaacatcacctatttcttataatggcggtgaatgtaccagagctgggcggtggcgaatggttgagtcaaaacctttctgaaggaatgcgtgctagtctgtcccctcgaaccctgaccctgcgtagtttaacctcttacatcactggtgtcaaatgcgtgcgtcttcatccttgtgagttacagccccgtgccttagcattcaagattgaggagcatagaggattggcctgtcatgtattactgcagaggtctccaactgtcaagcagtacgctgttgccgtcacctatgagtatgatctatttggaaatgtacatcctggggtttactgcttgtctgtacgccacgggccgcaaagacgttgctacactttctcgcccaacgaggatgatctagcatcatacatcagagatgagatgttgatagatgatcacttcaacgtcgtgattaaagaaggaggagctaaaacagtatactattatcctggggatgtctctattccagtgggtaaacatatactgttttatgctcattctgatgttgaagctgacctctacaacatttcattaatgatgcgtcttgcctactatcaatttccaaagccaggtcttgctcttgaggggcagtaattgaattcagagatgtatcttgttagtctggatgtatcttgttagtctggattaaggattaggattaagattaaagttaagacagttgcattcaacagcgttatatgtacttcttcttctggattaaggttagacttatgttaatttaatgttgatggccttccttagtgttagttgtaaaataccaataacatataaaacatgaaatgtaataaaaataataaaatataaaatgtaataaaaacaataaataataattatgatttatatgattaagttaatctgggctgcgttcataatcagtctaatcggcatgcgactaaattaaatatcgcgctgtttccatattcaaatttggttaattgaacctgtatcttaccgcaccctattttataaattaccatttcttcttcggctaatagtgtagatgattggacattatacgtgttgatgataccgttggtaaaccccgtcgcacacaccaggcgggggtatatgagtccgacttcgcgccactgtcggaagtcgtcaactcatagcgccttcgggttatatgttggaaacagacc

SEQ ID NO: 154 - DNA, 931 bp, Unknown
  derived from dsRNAs of unknown virus
  misc_feature (920)..(931): n is a, c, g, t or u
gggatttatcagttaacgagatggctttaccggcacctggactatccccaactaacattgtgtttgcacgatgtgacgtacaagcttatcggcttggaaggtcgcttcactattatggcagtgagtttttgcgattaaacagctcacctaacatcagcccttcttctattagaacagctagtttcaatctgactaacgtatacttatctgttaagaacaggactctttctgaaggaccacttgcagttttgtctcaaacggtagcttcaatagtcagtcagaatgcaggccctacggatcaaggtatgatgacaacgttcatcaagggtgatttcactactgtgaattacccgacgaatgtggctgctctgaacggtacagctggcgatttcaccaaccctggcttgtttttgtacggcaatgatggagtgatatattatgaaggtaatctaaatgctcaggacgtgatttcatgtagcatgttgcagaatgagaacgtttgggttacgtcagagagagcggctataaccattgatggcgcaggaccaccagcacgagatttcaacatgaattcccgtttcaacatcaggttgcaacctggcgcagtaaagatcaagatgatagctactagttacctacgtttcgatcctagtttgcttgatgaagctcgcctaggctatgttaggtttaggaagtttgcaactggcactttgggcggacagacatacttacctataagtttggacagtttgatagtggcagcgtataaacagaatcagttgctgacgaacgtaccatcagtgctcgtagcattattttcagcttatgaggtggtgtccagatgttattaagctcagaagatctggggtgcgactaggggggatcttcaccctccttatccggatcatctgtcgttaaannnnnnnnnnnn

SEQ ID NO: 155 - DNA, 872 bp, Unknown
  derived from dsRNAs of unknown virus
gaatatcatgacttactataatagtgtcaaactgtatgaaaagcgtttaccgaatgaagttgtgcacgatattcataagttcctatgtaataagataaaatttgacgcgataggacgaggttatggaatcgagcatggcgtaacgaagtgggatacattagtggataataatagtatattcgcaatattccaaagcactcatatacgccgtagtcttagagtggaggttagtaatgccatagcagatgggagaacgatagaggaaatagcaatgtgtatccaagatctcaatagagataggtatacattggatttcttcaataagttaccactgctaatcttaccttgccgattctttcgtgcttcactcatttttgttttcgataatgaagactctaacgtttcggtactaatggggaaggatccaaagaaagataatctatggacattcccagttggtaaagtcgatggcaacgagacatgggaggaggcagcgcatcgcgagttagctgaagaggtaggactatctggtccaatcagagagactgatcactactcatcagttttcgttgatgaacgaggccgccaattcttgactaaattcttttgcgcttctcgtcgtgagctaaagcatgctaaagggaagggaggtgatgagttattagatcaaaggtttgtgccaattgagaacatctcagattatttccagaatggtaggaagtgcgttgagtactttcatcatttcttacgcctaaaccaagttgatgacgaagaattccgccaaggaatacacggattaacactttgaaacacagaatggactacgtgactagcaccgcgtagagttatagtacgatcgtgtgatctacatc

SEQ ID NO: 156 - DNA, 1534 bp, Unknown
  derived from dsRNAs of unknown virus
ataaatttcgacggtagatgaccataccttgggcaaagtactaacctgctaacttggaatttcttgctctctttttggtttcagcatggccgaccaaagtcagaaccagaatggtggaagccaatccaataacagggaagtattgaaagcggtattcggtaattaccaactcacgcctcaagtcgcgttgtccaagcctagaacaaaagcaactgtgtctagtcttttcaacgaggatggtgaactagttaagatggaccagttgcagcgttacttgggaaacagttatagtagtggatttgtaggcatgaacatgagtgctaagcgtactattgctgagactatcttgggccatctccctggcgacgcaaagatcaatgttgaggccttcctcagattggtgatgcacgttgacaagatacgcgacgacgaagcaatggttagggtgacgattgtactctgtgacgtgacaggaagagatgccaaacacttgctcttgagggacaaacagtcgtatgagtttcatgatcttgatgaagattggacgtcgagcggagtgatggtcatgacatcagttaagagtaatgttaaggaaagctcaacaatcataattgtgcccgactcaccaatcatgggcgtagtgtatgatcggaatgacgaagccatcttaagcttgtatggatcttacgagattcgcaggaaggccggacttcagtacgtcctccctggagttaagtctgctcctttcggtttaagaggtaaagccgccaccattgctacagttgtgaacgatggacttgcgaacatagtgacgaactttggttatgatgagccttctactttcgtccaagcgccaaaagacatgcctatagttggacagatcagtggtactgacaccattccatcgtgtgttgctgctggactcaaaaagtacaaggaactcatgattgatgttgctatgtctagagaggatgaggacggtactcatatctatagtgtcaaagcgattcagatgtctcaggaattagcagccacattgattgatgttgacccttctgctccactaggatatttactcgcacttgtagaagatcgctcaatggatcgagtgtcacttctagatgctgtcaagggtaaagttgatttcgaaaagaagagagcacaggctgcagcagaattcgtcaatgctaatccagatgaattcaatgatatcatgcaaaagagaagggaacagcttgagaaggcgagggccagacgcagtggagccacacgctcgtctggcactcagaatcgacccactccaacgcaagccggcgcatccattagattcagtatgaaaaggtaatcatcatgtagactccgatccttgtcaccgttacgcatggatgcgggttacgagaccctcaagatcatcgaggctagaaaggtgactacgggagttgtctgcccgcctgatctgcatacggtagcagagggggggaagcctttctgaatcatggtaaagtatggtagtcgttctgtcatgatcaacgat

SEQ ID NO: 157 - DNA, 1099 bp, Unknown
  derived from dsRNAs of unknown virus
gaatattctcaggtgcaatattacattgtatcgaatggaaatgtattctgccgcgcattataagaaggataaaggatataaaagtaaacgagtccactacggtgaagagggtacgactgatcaagccatgtctccaacggacgtgaatgtagagctatataagctcaaagagcaagttcgtgctatgcatgacgttaaagaggacattccgatgttctttgatccgcaagatctctctcgtggatcatacggagttcatgttgataaatacctcggacgtagtccctgcgatggtccagctggctacattttccagaaggtaacttattcagctggagcggtagcctcgaagacaaacgtcggtggcatgtacaaattgtcgccggatcatatgggattcatttatcatgataacgaaactggtacggaggtgcgtattaacgaagacggtgccgacctagccggcgcaagtgacccaactcctgcgggcattagcggggaagccaaattggtaccaggcgatcttatactcggggcgattctgcagctagttgatacccgttcttccgacaacaggactggctttgtaactgctggcttagtgtcaaacgattcagctacaccggacacctatggtccagagctatctaacgaccccagtaatttcattaccgggagcgcaattagtggtggaaaaactcatgccgcgaacggcttagtttcgtgctcagtagcaagtccaaatctcaacatatataatcctacggtaatcgcaactgctgcgagtgatctagctccagcagcaatcggcgcgccaatcaatgcaattacagtgtcaggtatcagcccagcttcaacttcaaatcaaattaggtttcaactgcatgtatacgcgttggttggagcgcgtcagaaaacgatttcgcactatacccaaccagatccttcattccgcatggaatgtcttacgcgtcaatttgctgagcatcctgtttccatgatccattaatgcacgaagattacgtacatcaggtacaatgaaatacagccccaaatgcagcatgtcaaagctgggttcacattaatgagatgaaacatc

SEQ ID NO: 158 - DNA, 1631 bp, Unknown
  derived from dsRNAs of unknown virus
ggaaaaatttccaactagtaaatatttctttaagaagaatttttagggaagcttttaaaaagtgggatttttccattcctcagagtcttaattattagatatagcaatatgtatttcacaactcaaaaacaatttcaactttatataaacaaaataaatagtcaacttccttgtttcgttaaatttaatgtagaaagggcttcaaatattagttggatgaattcaaaaaagagtgcgacttatttgattgaatcaatcttcgttgaactatttcagcacaaaagtaaagtagacaagattatgaatgctgttggtgacacacaaaaaacttgtagtattaataggtctgaagctgttgagctattaagtaagtcatcagatatccaagtagatgatattatagcagccaaagtaaaaggagaaatgtccgacttattattattaacaggtaataagtataaaacttgctctcctagggaagcgttcgatactctaccaagtgcaactagtagtagctttccaaaatttaagaatcctaaatctcttattaaggaggaggtgattaatttagctcatcgcttattacatttagatctttctagatgtgttttagattttcctatttctattaactggcgtacgcaactttccagctctgggaaactcaagttcagacaattttatccttttcccgtcatagtagcttgttttgaaaagatgctctttggggaaatatttcatcattttgaaagaaataaattaacaccttactgttttgcaaacaactatattgacttgaggcatcgatatagacagtggcaacactataaatatatctactctatcgattacaaatcctttgatcaaacgatatcaaatgaattaattgagatgttacttagatttatgtttggacgagtatttttgaactccaaagagaacagtctattcgaaactattttaacttatcatacctcttgcttcattgttactagcgtaagaggcgtaacattcatgtttcagaagaaaagaggattgatgagtggatctgccttgactaatcttctaggatctttaattaacttatttattatactttatgtcaatagggtttataggttgtctattgatccaaaaagtatttctattttaggtgatgacataatctttgcgtcggatcgcaagttagaaatctcatatatcgcagaaatcgtaaaacttcattttaatatggaaatatctgttgaaaagtctcaagtcttctccgcgggtgaaagagtcttctttctcggtcactattttgatgacaaaggtaggtatttagatttagaacgtactaagtcgcaactatgcatatctgagacatacatacctgaagatgttctatctactaatgatagaatttggagtaagttctgttctattttatttaaatgttctgacggtcatgcgttttatgacttgtataaacacgatttattacagaagttaagattagctaaacctattggttattattattctttatttaataatgatggtaatccaagaaaattagtatcatttaatgaatacaaacggaatggctggatgctacaatagtagtgaaataggggcgtcaacccccatcc

SEQ ID NO: 159 - DNA, 2892 bp, Unknown
  derived from dsRNAs of unknown virus
gaaataaaactctctgagcatgagaatacgtggtcagagggcgagtgaaaacaaacggacacgcttccgtccttcgtcaaccgtactgacgagagattcaagtggttcaaaccgagacgtattcaactttcgtctagggtcctcttatgagttttcacaatcacagatatcaatcaatgttgatcagtacaattctgctctttcctcacagaatgatgcagccgtcttctcgggtcggtcatacgctagtcgagaccggtcattcaacaatcactctcccgctttctccttaattgaagggggaggtaccaccgtcatcggttacgatgataggtggcgtgttattacttacgtcgtcgctcatcacttcgacgaagaacaaaagtacattccggatgtcatcgaggtcccagccttgcagaaagtcggtcctgaggagcgacgcatcatcgtttgccgctccccagctcgactgcgtagactcaaacacaaggtctttcaagagttcggtagtgacactctgaacacggagcactctactgacggacatagacgagctagtgacttgaccactcccgacttaacgagtgtcaatatttggtactccgatcgtggatgcaagttcaacactgctcaccgcaatgcgcacataaagacgaggggcctgttagaggctaagaggtgcaactgccggcgagtcgaggattctgaagctaatagtcgcggcttctgcgtgagttgtcaaaaatcttgtgttgaattcaagaaggagcgatcggttgtcataacattccgatctggacgaggtgatattcgcagctctctcagccgttcgtctggcttcagatctgaggttactagagtggttcgggccgatagagcgaatatgtcagtgaggaccacgtctttcgctcttcggtccatgagaagagccatcgctctcaatagagccgagggaggtttcttaagtctcgccgaggcgcctgttccctcttctttagtttgtgtctgtgggctttgcgatctcctaaacaagcacttaatggcccacacttcgatgtgcgggaggactgaattcagcatgaccaattttctgggagggttggacgttgagcctcccaaaagctcaggagactcaagactgagacttacctcaatgtctggacgaggaacgagcaactctgtgagtacaacgttcgaccttaagatgtacaagaaggatagacacacagctttgcatataagaccgatccagtctatgagtaatgccgttgtggggggtgtacggttggaaaacgggtggattgatctcactcagttctctggcgaagtagacaccccagcatcgcagattgctctcactcaactcaggaaaattctcagtcctgatgtcgacgttagtaaccgattcgtggggtcaccctcgaaaatcacgaagttggaggctctgctcagcagtatgctgtcggccagagaaggccggactagggccatgcctgtgtacaagctgcaaggatcgatgcatagtctcatcaggagaattcttaaaggtcagactactctatctctaactgtccctacgctcccaatcatccctttgagtaattgggggggagtcgttctgccccatactccctgcgacgctaagctagctactcactttcgaagattgtcaggagaatctctagccaggttcgtgaatccactggtatctggtaacacttacctctcagtgcctaaggctgtacttgaggttgtgcgtgccagcagactcactgaggccgtaaagaatctgttcgtcactggctcaaatgacgctatattttctctggtcgctaactctcctacttgggaggaaaccaggactgtgggctcgtctgaggggactgcctggtctactaagagctttcccacccgatacactgagataagaggctggaatccccctatccctactcggcgatctgacctttatcaaattaagcacagaagctcccagctgcttcaatatcctcagacctacaccgatcaagccaaaccttacagcatgaaaacggtccctaggtctcttggactgccttcagccacttcttgctgtgtgatcgaggggttgaacggctctcgttggacttccctttaccggtgcatgtcccataaactagagagcatgggcatcaaggttaatggtcaagtgaatttgaagaaacagctgagccgcgtcaagaccagtttgagtagcctctcggggcaaatagtcaattgtcctcttattgctagtgagaaactggcacatggcgacatctgtttggttgggcctacagatcaggacggacggtgtgctctatgtcgtggagaggtgacttggacctacactattgataacaaaggagaaccttgctataacatccagcacacccaaagctgtcctaaatgcgaatccaaactggtcgaagctagtccctccggatattcggacaatgatctggctttcctgcttgatagtacagagactcacgaagcctctagtttgaaatgtccagagtgtgtcactgatcaatttcatgacgaccacagttctgccttcaaggtagttagagtggctcaaactccgatcataagggagtacttaaacacctgcctcgatgagaagatgtggtgtcacatgtctggtaccaacgatgggaaatcagtgaaaataaagttcagtggggggacgttcactattcctggcttctccaccaccacactccttcccgccgtaattggtcaagacgattacgtatttgctatgacgactcctggctcgcattatgatgtctgatttagagctgtattgaactgatctgttgagcggtatgaatgaaaactgtggtattaccccatcttaaactt

SEQ ID NO: 160 - DNA, 1462 bp, Unknown
  derived from dsRNAs of unknown virus
gggaaaatttcttgtgatttccttccgtagaggtgcctataagacacaggcgaaaggcgcaccgctgacctgctgtcacacaagatgagttattacggagggaagggattctgcaacctccctgagacggaaatgtccgtcgactgggatcccgatcccaaaaattgcagtctctttaggaggaaagaatatgtctgatgaacataacggcaagccggatggacgcgcacccactggcccaaagaacgaagatgcgcacgtcgtggaggttgctgaagtaaaagcacaccgccgcgcaataagtgaggtagacgatagtctacttattacaggttacctacgcctggacaaggacgacactactgtagttcgtttctgttgggataatttaggtcatctggtctctgataggctaaggttcttcgaactcgatgaactaccctacctttggctagaggaaatggacgggactaggattattgacgagtggttcagcagtgaacatccgttacttggtttcataccattaacagtacaggaaaacgttttgcacgcgcagatgatggcgttcaacgacgatctaagttactggctagagcaccccaccttacacgacacagtatgggatacagtgaatttcgctgaacttatccaggtggaggaatacgtttgaaagacggtattgtaataccaggaaagcgcattgagcggcttaaaggaggtgctgtcaaggttgaccgtcaatggttacttgatagtgtcttacagtggttcggcccgttcggcacagttgtgcggaccggacaccgttgcgacgcgcctgggtgtaaaggtgaactcgttcacgtttacgagacaaccgaggtgcaaggcaaaccacacaagacttgttttacgcaaacaaacaacggcaggaaacgtacgtcgagtaaagtatacgactcgtgcaccgtcccatcttgtaagatgtggggcgagttcaccatcgaattgctcgatcaacacgaagaacaagccaaagcgtacaggaagcaaagccgcacatggaaattcaggaacgaccgtaggaggaagaggtcatgaagggtatcataatagcccaataccaggacgaaatcgaccactggatgtcgacatccgacgatgacgtcattgagtgctgggcagatgttgcatacctcaatgatctacagtggacacagcaggaagtagaggaatacctcgacagtactgaagtggacactatacttctcgtatcgggcgtcccctggaccaggcaacctgtgcatatagtcgcaaacataaagaattgcgtaccgtatggatacagcaggtcgactttcggccacgcagttaacctcattaagaggctcgcttagtagaaccgcctctggggcggcacgggactccccgctgggaggacgtaaggagtttggagagctctgagttgaaaactccaccc

SEQ ID NO: 161 - DNA, 3952 bp, Unknown
  derived from dsRNAs of unknown virus
  misc_feature (2320)..(2325): n is a, c, g, t or u
  misc_feature (2670)..(2732): n is a, c, g, t or u
ttgttgtagattgaagatttttagaaaaagtcatggaagctgaagaattaacagacagttcgtgggaaacatcaattcgagcagatccaatttttaggttacagtattattcccttgttggtagaaactcttatcatacgagagtcagtgctctaaaagatcgtttttcaacgattttccgtgtcttacaaaatagagagataagtaatgtttcagaagacatcggtctgagtttgatgtggatcaaatcaagtcatagaatgtatgcagcgaaaatcgactcgatgagttctttggaggttgaacttgagatagctgatttagttagaaaattgaaccttttagtggattcctacatgtataaaaacacagtgaaagttccaggtactgagaatacctttgttagggaagtgtacagacatccgttttctctcctttattctgaaggagcgaaacgtcgtgtttttgagaccgctccagagtatgtgcatgatgtatttctgcccagcgtcagtttagatacgttgatagagtcagcaaagtcttccgaacacccggaatcattcgcgaaacatgcattaagtcgatacaagaaagaaagcattgtcaatggaaataaaggattgtggcagctcatttatactagagtatttttcaatgttctgtatatgagtgaaatgcaagacatgttgaatgacacttttggaaagaaagatgacggaaacagtgaatacctacctccagttgagatcagacaagataaagtcaattttattgatcctgatgacttaggtggtccctctcatgttaaagctctggaaatactagagaagttcaatttttatgctgatagattgtatcgcttggacggagttttgtttaaggccattaaagagatatggagttactgttatcgtgatttagctgcagatttagaggttaaaaagatgctaagtatgttcagaagtaccgctcatgcgctaagaaatgagcctacactcagttataattgcaaatggaacgttgtctctgatggtaaatccatttatccctctttcctgggtggtgaaacttttatgcatgaggacgaacgcgtcattggtgaagtggtgaaagatataaatgaagatgtattcagagagtcaattgacaagttgagggctactggtatgaaatctgtttgctttatggcatatatgttagtgaaaagtgctccctatcccgttcattgcaatctagaagcagttttgaaattcaaaaagcgtaatttctggagtaatttcacgttcgacaaaatgttaaaattcgatcctccagctgacgccggtgtcgtgtatcatgttcttttcagtttatacgaaattcgttattcctacggagatacttttctcgctgatcctgaattagttgaagtgccgtccgttccagctcatgtcagtgacctgaaacagaacgtcagaattatcgaagagcggtctgaagaagtagctcacgagttctttgagcaagatagagctggtccgaaaagattatctgatcgtggtagcgtcagtagaatgagcgtcgttggcactcctaaatcgtctggattacatgatgctgtggttgtatctttcagatttgaaggtcgtaatgtatctatgaacatgacggggaagaacgctacattgttggtgcgaggaatgcaaatagctagaggagttgaccttttaaagaagtcatctagggtaatgccggcgggtaacagaatcgctcgcgctaggaaacctagaaatatttctcctttatccatagtggttaccccgcctggtcagcttctgaatggtttgagtaaaactataagaagagatcccgacaaagacgctttccatttctgtaatgtgtttggctttgctaataagactttaggacgtgaacttcctgataatgcgttagtttactattggtccagtttgatcggcaggttgaaatacgccgctgatgctagtgcttgggatgcgcattattatacctatttgataatgatcatggttgcgatgatagttaaagctatgactacgtatgatgatatagcttttgatcaacctgtcagtgatactaatccgatttttaccgatgacgcatcagctacccttaactggaaagaagtcatgactaaagctttaggcgaaggtttcacattaggtactctaatggcggctggttttgacgaatatggagctaagatcatcgttaaattagcgagaatgccatctggtgcagcttacactctacttttcaattcgttttatggagctgcaatcgccaaggaagtaagggnnnnnncgatcaggtcaaaatactccattcgttatgaagaagctcaactagtgggagatgacgtcatgtacttacttgagagtggtagattttcagaacgtagaattcgcgccaccttcctcgaactgattgaagtgtatggtaaatttaatatggaaatcaatccatccaaaggtggtatgtcttatattatagctgattttctgaagaagaaggcagttaatggtatgaacatccaacctgttacgggtcttctcgctcaggaaaaaattacgaatttagatcctgttgaggatatgatgggtttgaaaggtaaattggccattctactgtcacgcggtgtctgtcatnnnnnnnnnnnnnnnnnnnnnnnnnnnnnnnnnnnnnnnnnnnnnnnnnnnnnnnnnnnnnnngtaagaagaaaggtttataggctaggaaaatacatgattgatccttggtatattttctctcactttggtttcggattatctctctttcagctttcttttaacagttctttcattcgctattgttttgaaactgaatacagggatttatgtaatgaacgcactccagtcaaactcgattatagcgatagaattttaactaagtatcgtgatgtaatgcgtagggttttgaaaaatccttcttcgagctctgagggtagtatacattataaggtcgatggaaaaaccacaaaagtgcgtgcattagaaggtattcagctatacagtcagcgtcttgagaaagctagaatagagatggcgaaaaggtcgacttattctgaccgtagcggcggttacctaggaaagccgattgaatttgcggtttccagcttgcctcccaaagaattgaaaaggcatactttagctgattcaagatctcttttgttacgtaatttcaaatccggtcgattttcagcctctctaactgaagatgaacaatcgtcatttaacgttctgaacagaattaagatatcttataccccaatgcctgattccgtagagctgaattgcactcctcacccttacaccgcatgtggtagcatgttgttgaatttgagtagatttcttactatcactgcagatggtaactaccgtactgtgtccaaacttaataggatcattggtgatgttgcgagacctgaagatctgttccgtaaactgaaattcagagatcgtgatttgcagattgaaatcctaaaattttatggtcttttggataaggctgccgaaataatcgagttagtgaatattacttctgtagagatgttcggtttcactaatgagaaaggcttacaatccagtcaagtgatgagctgcttctccatgaaaaatctcaatgatcatattcgtgttgttactaatgatacggctaatttgaactcttttgtaaccgaaaaattaaaggttatggtcggtggtttgttattttcgaaaatcgcttttgacggtcatatgtctttaatgactttggatgttccctacgatgttgcccatgaacttatggttgctagtgatgtgaccatttagtccgttacttcttctttaatacatgattttctttcttgattcaatcttaaacttcgcattctgatttgattgcggaggagacaactacaaataacttt

SEQ ID NO: 162 - DNA, 2728 bp, Unknown
  derived from dsRNAs of unknown virus
gaaataaaaaggtttcaggtggtaacctggccggtcttgaatcatagtctgagcaccactgggcgtgggacttttatttgagacttctgtatggctgaacctcgtgcccatcctcccgaaaggggtggggcgatgcccggtcatgctcaattactctttgatctcattgaaaatgtaacagtcaccgctgagggtatgtcctcttggttgtccaatcagccctcttcgctgagagtccttgctgaaccaatgcatgggaggtctcttgcttctcaagacttcatccaacgtgaaggctacgaacatagcggacttccctccgcttgtatggtgcttactaccgctactgctcgagttggcggttgttcaggtaatatatattacggattgaaatgcattgcggggattcttcccgttatcacccttcgcagcccaccagcttttatgactgctccagactctgaaatgactttcccggctagtcattttgacgtactcgacatcattcccatccagggagatggaatgagccccaggcaatacctcaccaaggagttgaatgatgctcacgtccttcggagtggtgtgcgagacggattcatcacgcactccctttgtttcaggagggatcagccaactggctatgaccttgctggactccccgtcgatgttctcaacattttattgcgttcggtccttcaaaagttggaacgacgtagagaagctcgtgaatttttcgctgaaattgcggcccaaatgagttttgatgtcagaatcgtcaaggctttgaacgggccatatcagctaaggttcgtgccgaaagctcactaccccgaaggcaaagaagtggttagaccattttccgaagccctttatgcgatgagtttgaggttcctttataagggtaaacccttgtctcttaatgagtcagcgtttttggttcatgataggaatgatgaccgtcgatttcttgctggttggttagaacgatgctttctttatcaagaacgagatgctatcggatatggtcggatcgttcaaatcctgggggatttcgaattcccgctcttgactgatggagcgacagacatgcgaattgaaacggctagttacaactacctgaaaaaccttccggctggagaaaaatcgtctcagagtgacttcgatagcttcgcacgactcttcacaaatgatgtgatgctggatcgttttgggaccctgattcctatgaatgatcatcagtacgcggaacgtcccgtcatggcttatgatgattatgttgaccgctataagttctgctccggggaggcccgggcagatttgattgggggggatcgaaagatggcacagattgtgttcggtgaaactctctcaatgcgcacatctcctgaagtaatggctaaggtatcttatcggccagggtctggttccttcatatgtattgaccagacgcgcccaatccgccaaaggcttcgacagcacgatggattgagccagaagcattttggctttgccaatcggccttggcacagggatgatcgtcggcatttgcttgattcacgatggtctaatgatcgtctggattggcagtttccgccgggcatgagtagttccggtgtcgcgcttctccctcttggccacatcgtccctttcctccataatggagctgaccgtgcactgtttcgtatcttcagtgcttaccatcacgccgttgatgacggtagagggcgaataagtccggctgcccaggatgcccttcaagccgtgagaagtatcaatcagatgtggcgtttctgtctctcatgcttttgcgtgtctggatcatgtcagtgtgtgggaagctctctgaagattggtggactgtgggggtggatctgcagcgtcgctggttgtctcctgcgaagttatgctcacccttttgatcgggattggaagtttaatctgaacggcgaatatgtcaatgacgattccagatctgctatcaatgtgaccgctatgctaggaactcgtgcgctgttggcccctctgagaaccataaaagcctgtaccatgtttgatgttgctcctgacattgtggaacatttatctggcaacccttccagtatcactggcaccacacgcagattcgaccgttctcccagcacaattgagcgccgaaggaatctaatttgtactcgcactccaatacaagacggggattgtctcaactatcgagacaactacttctgggctgaatgcgtaggctctgactgtactatcacccgacctctcgaccttgaccttcaaagcggtcgaatcgcggttatgaatcctagtgcttctattgaagtgtctaggcctttctctaaagtcaccaggggcgtgatgtgtcaaatttgtaaaaacatttctgagtgcgggacgcctccgacgtacgctgaccatggtactcaatcccactgggataaaccttggactgcgcagtgtgatctttgtgatcgctcaactaaccgtgttctcgtcgggggtatgcttaccttcgacagttcctccgattacgtacttgttccaagacgtcgggttgacacttttgctcggcgaccctataccctgaagcagcagattgacgacaccattggcatttagttacagagttattgaacacatattgattcgcgtgggcatgggggtggctccctggtacagtgtccaacacgctgatgtcaaaaattatcattctttaaaactt

SEQ ID NO: 163 - DNA, 904 bp, Unknown
  derived from dsRNAs of unknown virus
gaataaatcagtatgcatagtaacacaatttccatgacgcgacgacatgattgcgtggagcaagcaacgacattcccattctcaccgatgggcggtgtcagtactgtaacccccggccacgtgaggtcaatgactatacgggccgataacctaacaatttttgttaacacagatggtattcacatcacaaccatgaatgatgaattgttcttaaacgatcacattcctaatgatagactgccagcattgagaagcattaacttcgatggtttaacatcagaacagcagagtgagtcatctcaagaagatgacgaccatcagagcgttcttagtacgccatcattgaacatcgacgcggtgaacgcaatcttgctagagaataatgcaccgttaacaccaccacagagcccgaacagatccccagcgactgagtgtacgccagtggtggttgagcggcaagaaagcaagcaaagaaagcgtgacgcacgcaatttagaggactcaagaactgaggcagatagtgacccctatgaattttcgtcagaacttctcaagtactttccaacttcaatccagggtacatcgcttgaaagaacacgacgttcagatagcaacgcaatcttcttcacgaaattcggcgagtgtgctggacctataagggtagatttcaaggagaagtctggctcctatagcgccattgtcacagaccgaaagattaacggcacaagaactccgattaacctgtctcatgatgtcagattagcagagtttaagccatctgagagcctcgccccggtgactttagaagctatgcaaaccatacatactacgttaggacagacccttagcacaatgcgcagcagggccggagctaacaggtaaatacatgctgatagaaaacgtc

SEQ ID NO: 164 - DNA, 983 bp, Unknown
  derived from dsRNAs of unknown virus
gaatattatacgacatattgaatattgctcgtgtaatgtcaaaatacaactgtaatggaagaggaccatgaagacgaggacaatgacaagcgcttggatgatgaatgggcatcggctgaagtggtactggggcgtcttaagcatagttgcttcgctatgcacctgttatatcgtcgccgctacattgactcaagacgcagactttcgttttatgatgttcctattattgtattttctgcaattaacagtgtaataattgcgggcggcaaagatttcataccagcagatgcgttacagatcatgacatgtcttttggcagtggctgttgggataattcaagcgataaagaactactttaagattgatgaatcacgcgaaagctgtttatcaacgtataaggatttattcaggctattttgtgaaatttccttactactcgatcagcctcgtgaggtacgtgaagtcgagccacgccgatatgtagccgataagggcgttgagtatcgtgatattatggataaatctataattctagaagataataggactaagaggaatccaatatatgaagataacaatccctacgttgctggttcgagtgggctatcaagcctatatcatgatacgcctgataaaagcgaaggctctgaaccagacacatttttgtcacgtcaaatgtcacttaaaccaattgtaacctcagtcagcacaccgaatctccctaaatatgagccaccctcccctgttgaagaagaccaaactcaacagttagaaacgattgttgaagtaagcgagccttctgaggttgaggactcttcaactcaaacagcggaggagctactaattaggccggtggatcaggatagttccgattccgacaatgagtaactgacgtacatgagatcatgatgatgtcgacatcatgaattcaatacgcatcgtacgataactacgatgcggctcgttgtcgcatatgaaacatc

SEQ ID NO: 165 - DNA, 1380 bp, Unknown
  derived from dsRNAs of unknown virus
gaatattttgaaggaccgtagtggtgcatttaaaatgtcgacgttggaaatcattaaaggaattacggatgagctggctaatgaagagctagaggacgaaaagcgatctaaagggctattgaccgagcgcgcccaagagcatgcattggaaatcgatggcggtaagtttaacgaaggcttcgagaatatcatgcaatgcgtgaacacgccgctcgaggaatcgattagccaatatggaatcaggctcatggccattatcgcttcctcgtacacgactggtgcggaggatgaacgaaaatattctgaggttgagtctaaaattaaagaattgaccgagaacatggatgcggatgatgctttgattattgatatcaaggataagttgcatgagcttcataagaatcgcagcgcacttgataccgagtaccgcgccgttctagagtcaaacgaggctaaccagcgtatgaaattgaggtcaattagcgatgagcttgggcttctacatgaagttacagatgaccactttgacgcactcaagaaaacagtcacaaggcgcaagttcctggaagcggagctggacgcgaagacgaatgaattaaatgagctaaagactttatcgcttggagatatgtttaacgctagggcaatgctatttcatgatccaacttggagtggacatgatgatacagacgaaaagctaagcccgagtgcgaagcgtaccctcattgatgctttcaaaaagccaattctcgataaactgagtaactttcatttatctaaagagtatgatagtcaggttaaagtgggtgtacttgccatccctcctcctagtggagcattcaacggaagtgctcgcggcgatctcaatcgctttaaagaaagtgaagtggctaaaaagctgtcgaacattctgaaactacacatctccagtagacatggcgacttctcgaatcgtctattcagagatgtggtgttaatggacacaccacagaaaaccgaaattaatgattttcaacaacaaatgtactacctaaatcttaccgctatggctggttatgatcccattcgctgggcacgggcttttggagtaccaattagtggaattggaaaacaaatcctgagggaatggaataatggccgcacaggacccttgacgcctgaacgtctaattaagctgtttgaatctaaagcgttgcccttcacagctgcgctcagctatgctgagatggagcgagaagtggcgcgcagcgagctaaagcaagatgtacaggacaaacgtgaagctgaagccgctcatccccgcgcaccccaacgagtgatcgttgtgaagcaggattctgatgatgaggcgtaagcagtgcattcttcaaatgaaacatc

SEQ ID NO: 166 - DNA, 1905 bp, Unknown
  derived from dsRNAs of unknown virus
ggacgaaaccatgattcaacagcagtggctagttgttgtaaagtgggcttttagaatgcttactgatctcaacattaccggttacactcctcaagaaattaatcgtggtttggttgattacaatgatttcgtagagaaaagtggattggctgatgatcatgttttgatcgttctgtacaatatcatattctctcctgaactgatgctgactcctaaggtcaatttcaaacagatggaaagacgagtgacgaacgtgttgggggaagatatctatttcgatctcgctgataattttgtgatttatgagcttttcagttctgtagctgatatgaatagatatcgaagtcatttagatatgcaacttaaagcatttcaggagctgattcgcacccgattgagcaaatttcttccacgagcaaaaggatcgactacgttgattgttagtgctattgaagctctactttctcaaaccgaattattcgttcgttctctggttgcttttactgaaaggaaaataatcattggcaatagcggattgtctaatggatacgtggcgactgaaccggctgagcttcttggtttcgtaatttctctcgctgcagttgaaaatggcgctatgcctacttctcaatctatcggacctctcagcgacatcatcgagcaacttaagtatcgtatttatgatcgacgtagatccattcaaatgataatgcatgctttaactagtggcgatgtcatgaggaaattgcatctattcaaagaattcgtttctgaattgaagaaagtgcatcctctgctagatgcttggattgaaaatcatgtcgatccgaatagtgtggatggtctagttttgaattctttcctctttgatacagctgaagtgccaggagagattccatctcagtttgttgatgagagtgaggccattaaaatattcgatgatcattccgaagtaaaaagtaattctgtcgcatctgctttcgtttttgacccagttggtctttcgtctgataccagaactcatcgtgatagtccttcaatcatcaatagttcattggaagttcatgctcgtatgaaacctcttccggccatgcctaaaggtacattgggagctgtttcatattggttgaattatatgacgatgaccagtgaattaccttctgattttgataacccgactgaagatgcattgggttcaactctctctttagtagatgacgcagatgattacgacactactgttagccgtattattgataatcgttggataggcgtcatagatataagaacgggtaatcaagaattgctgaataaagtcctcaattacgctcgaattctagacatacgtattgctttcttccaagatattaacgtctcaatggaattaaggaatttttctgatggtgctatttcaatcgttgacaatccgttgtcatatttgagtcattcaattcaattaaatatgctccattatagcgtactttccataactgacgttgatctcgccgagacgggcagagccgttcttgtatctttttatcccgtgttgaataaactgcccatccgacagatagaccctgacgataccgatactttccgtactgatcatgtatttaacattagtactgcttcttctcataaaattctggatttgcaaacccaattggataatcttgatgatttaccaatcatggcgactcgtggaaccagtgaattgcatggcatcaacatcctggatgatgtagttatcccagttactggtggtaaatacgctcgaggaggtgctggaggcgaccttggtgctgctgcgcccgtcacgagtgctgcagtacctgattctacaatctaactctaattaaactctgtattcaccatgaccttgatatgtcaaatacttaaaacttt

SEQ ID NO: 167 - DNA, 1248 bp, Unknown
  derived from dsRNAs of unknown virus
gaatattcttcggaacaatataatcgaattcaaaatgagttataatgctatggatgaaagtaaatacacgaatacgtatgatcaaggaagtgacaagatcccgatgttcttcgatcccgctgatcttagcctaggcagttatggaccacatgtggataaatatctaggaaggagtccatgtgacgggccacctgggtacatattccaaaaggtgacgtattctgcgggtgcggcggtaggcgaaacttctgtcgctggggtgtacaaagtatgccctgatcacatggggtatatctacagcggatcaaatacggtattcacaattgccaccagctctgtgaacacgtcaagtaacaaaatcactatctcaggccatgggttcagtaacggtacacgtttgacctactcgaagcagggcgccgaaaacaccgcgttgggcgggcttgaagatggtaccacatatttcgtagtatcggcagcaactaacgacttcgaactcgctactgtagcgggtggctcgggaattgacctaactggcacgggtaatagctcgcagactctggaaaggagcactgaggttagaatcaaccaagatggtgccgatttatctggaacaactgatcccacgcctagtggtatctcgggtgaagccaaactagtgcccggggatatgatccttggcgcgatcctgcaactagtggatactaggtcgtcagataatcgaaccggtttcgtgaccgctggcctcgtgtcgaatgattcagcatcgccagattcgtatggacgtgagattgcctccgacccgagtaattttgttacaggcagcgctattagtgggggaaagacgtcgccagctaacgggctcaagtcgtgctctgtcgcaagccctaacttaagcatctataagcccgtggttgtcgcaacatcggtaacggatcttgctccagctgaaattggagcgccgatcaacgctattaatgtttcaggtctggcggatactcaatctaaccagatcaggttccagttgcacgtctatgctttagtcggggcgcgtcagaaaacaatctcgcactatacgcagccagacccagaattcaagatgagttgcttaactagacaattcactgaacatcccgtatcttttacgtattaatttgaacattgcatactaacacatcatgtgttcgatgtatacggttcctaatgcagtttagtcagactgggttcacattacgaagatgaaacatc

SEQ ID NO: 168 - DNA, 1953 bp, Unknown
  derived from dsRNAs of unknown virus
gggatttttttgttttagtgcaacatggcggtagtagaagttccattcgatacagcaacattctcattagagaatacgcaagttccagattatggtttggatccactgtattctcccagctcagggttgttcgctggactctcttcaccaataacgaatgcatatgaacgaaatatccatggtgcaatcactcaggcgaggtctaatattaagagaatttcaaaagacaccgatgcttatcgaactcagttagaaacagatttgtctagcatagccacccacatcgagcatgagcatgacaaatctatagctagtgacagggtactgcaccatctggcagatgtgttacacgaagaagtagacagtgaaaacaacttagctgctgaccttacatctgcggtgtataaggatgagagtgctatagctcagttgattaaggatactaagataataaatgctgctgagaaagctgatctcgctcttgagcagatatctagttatgccaccattgctagagatacagccaacctggcagctgacgctgccgaggtcattccctttggctcaactgctgctggattaattaggacaggtgctgacgcagctaacgtgatagcagagacagcaactaccatcaaaagatcaggtgtgaccaagacactggctaatgtggtgactaacctacatactggtgagctgtcgcctcatgaattaatggcacagtccatctcagtggctaaggatgttaatgagttagtgaatgagcttaagaccattcctctacgtagggaacggaggctagagctaagctttgcatcagcatcggaccctacgccagaagtacataactctgagttctacaccacatacggggtcgagggagcaccggtgtactatgttatacgtgactcacgctctccttactatgctagggttaagctggatgactatggaatgatttatgagatcataaaaagagttgatggctctaaacatatgtctaatggtaatattatactatctggtagtaagaagagaatagctaataaagctgagatgcacagtgtgatggcgttatgcaagctctttggcggcttcagtggtttatcctataacctcaacactgctcgtggagtattggagacactggttctacttggctctgtgcctcgagagtcattgaccaaagacacttatgataccttcattgagtacaagagtggttatgatcatgacgttgttgagaggtacgatcatcaggaaatgcttacgtctctggagcagcgtagagaaaattggaagttggataatccggacagagttgatctgataggaagggattcacgtgtagcaggtcatgatcaggtaagggatgccactctgaagctccttttcgtcgaaggtaacggttacaatgtgcttggatgtagttatggacctgtgacgagagccggtgatttacgcgtgtcatgcatcatcggaggtgcgagtaacactgacaaggccatcattcagtatgctacccagaccaaggcgtacgtgactatcaaggataacgaagacgccctcaacagcacgttcgtaatcacttcagatggaggtcttcgcatagacgatggtgatatgatattcttcagagtatacgtcaagcctgagatgagacctaggttgtacataaaaatgcatgatgttggtgatgatttccacgccgagatcacccctgacatgcatcatgatagtgtggatttaagacgtccttacaaacataggtacatcgaggtgcctgagatcataaatgcagcaaccttaactacaggtaccaatctgtggactgcatacgtagctcctaattggacaaaggctgattaatgtgtcactttggaatttcgctaccgcagcggcagggtctttgacattgctgcctgccgtatgtcgcgacactattcaaaaaca

SEQ ID NO: 169 - DNA, 3479 bp, Unknown
  derived from dsRNAs of unknown virus
  misc_feature (1306)..(1595): n is a, c, g, t or u
  misc_feature (3092)..(3092): n is a, c, g, t or u
agaaaattttagtggcggccctttatgggcctaaggcctttttgccccaccgaagttctctaacaccacatccatcatgaacaaacctgatgagttggctgagctgaatctcacgccattcgttccctatatcgcggtggtcctcgcacctcccgcggctggcaagtccacttacgtgcgtgtaacgcaccaagcgctcatggccagtcacaagggctacctgcaacacgacgggcataccctgctcgtcgacgccgacgacatccccgtcatcgccaacatttaccgggaactttcgtcccttgcacctggatggtgcaatcttccccagtatagtccgctcgtgcgtgcgaagaatctgagcatgcgagcagccgccgccgacattcgacgtctcttcgagcagtggcactcgcacgcagtggtattcaccgctgaacatcacctcgcaacggcccttgcgttcgatacgatgcgggcgttctccgacgtgccgggaatccacgatgttctgagcgtcgtcatccccaaccttaccgactacagagcgagctctaaacggcgtcgtgaggaggctcccagtcgttggacgccctccgacgaccaaattgacctcgcacgccgtaggttcaacgaatttgcgcacacccaccggcttcacgcggccgaatcgattgatcaggctgcttccacgttgcgcatgaggatgagttctatggtccgggtgtcctgaaacgcaacccaacatgccaaacgtaaggtactaccctctccgacatatggctaccgttttcaccgtggtggcgttcgccctcggttggacgtgcgtctacctgctccatgtgtggggcacgggtgacttgctccgcacgcggttgaccgctcaggcgctggcgctgttcgccatcgccatgcttctcaacgcgctgttcgcccccacctgggcgagtcgccgtactcctctcaatcttggcctctttctcgtcttcgtacacgtagcgttgatgggggtcatcatctgcaaacctacactccactaacaccatgaccatcgctgaagtactgaccaagttggctgtcctgcgcacgaacctgtccgcgctcaacgccggcgaagccgccatcgcctcgcccggtttgggtgaggccgtcggacgctttgtcgctgacatcgaagccgtcgaacgtgccctcaacaccctgatgcctccccctctcgagggaccgggacaccggggtgctgatcatcagttcgaatcttcgctacccctcaccgaaccggagccgagcgcccccattgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccacgagcgtgacacggcgcgccttatcagcgtgttcgacaagtggcacctccgcttcttggaacgtgtgatccgcgacatgcgcgcgaagcccatcgggttgaaccgcatttcgcgttctccctggccctatatggactacccccgggaaccggggctcaagaagaagcagttggacccgttctggcagcctattcttagcggtgacctcgggtactttgattcggcggttgtcttaatcaacggtcgaatgcaacacgagcggaagtcgaaagttcgtaagttcaacttcctctcggccgacggtgtacccgtcgcaaaggacatcgatgcgaacgggcgtcgtatagatacgcccgccgggcccatgatcgggtcgcgctggcgtaacgtgcacttgatgcccgctacggccttcgtgaagatggctctggataatacgatgcacggccagatgttgaagtacccactctgggcttccaacatgtttggctccggaaaacccgctgttcgcgggaagctcggagccttggacgtttcgcattttgaacgagtaaccgccacgtgcgtggaacgccgaggcgaacacattggaggcttgttcaacgacatcacccaacagcttgcgcgtacaccgtacctcgtaccctcgatggataggcgcaagctgttcaccgtcatggcgaatcgccgcgagggctggcgcacccaattctcgagtggcgaccctgccgtcacggccggtcagaagatggtgcccgcgtgtttgtacgcggagttcgcggtcacgcatatgaacgtgcccgacaacagagttatcgactgggttctgaacggtggtgacgaacgtctccgcattcacaacttcggcgatgaccagatcgcgtacggagaccccgccgctgttgatgcctgggccgccttcatgggtgagttcttggacgtcaccgcggaggtgcccccaaaatatcttggctgggtgtacgacgtaagtggggcaaccttggccaacccgtcaggttggtccctccccacacgttcctacgacctagggtcggtgctcgctgagcgccccccgggtggtaagcaacaagagctgatcacgggcatcgattacgccggcttccggcagtacccgttcatggccttcttcttgcgtaacgaaaactacgctaagtacggtcaccctgccatcgtgcagaagcggattccgctaatgctcgaaatgttggcaaaatttggcttctcccacgcccggctcctcgagctcgcggagaaggatgaggcacaacttcgacgcgacgtgctctccacaccggaggaccagatcgcggccgatccacgaacgctcctgggtaaggagtggctcatcacccccgaggaacgcgccgccatgggggcgagtaacgtcattggtgcacccgctgtcgccgacgcagtccggcggcttgtgggcaaacaatgggtaggattgctcgacaacctgtagcatatnagtagcgtataagtataatatagttaattcatagcatgtattatggggtcagcctgattcatattagtccctcaagcatcgtaggtttggtcaaaattttgatgtcatcgtaccctggtacgatggccgtcacgctcacacattgacggactcggcggcctcggagcaggatccgaattgggcggtggtctcctcggaagctccgagcatctcagcgaatccatcaacatcggccttgcaggtgcagacgtgtgggtagtactcatcgagcacatcctcgaggagggcttgttgctcgaaagcgtagagagcccaccaggcggaggcgaggaagtaccagaaggagtatccaccagacacgatagcgcatcttccggcgttgagacc

SEQ ID NO: 170 - DNA, 1480 bp, Unknown
  derived from dsRNAs of unknown virus
gggatttaaagcttttccgtgagccaacatgctgaccagggtgtattccaaggatggaccgatgctggatattcggctatcggattttacaaagctggaacaaaggaacgttctgatggagtatgatgaagtaattggcaaattgaggtacgccatgaatgctaagatcttgaatgctttgaaaactgtatataacaatgtagataccaaagtcgctttttctagagtagtgggagtgatgcatgactattgtataataccaaaggggttggagcaactgctctcattcttgacacatggtatgcaagtaggtaagatactgatgcagtatagtgttgatggtgagttgaaccccattacatataagctactatttgggatgttcaaacgtgctgaggcgcagattgctgatagtaatcataaacaatgctatgacttcttcgcgaaggaggatggtgtcatctacacaccaatgtacacaataatgccactgagtgctgttgatgactatcagaagaagaaagttaagctgagggttgagaagttggggaggggaaatagtctggcatactgctacactcaagaaggagggtatgagttttacgttgatgacactcagtatcgtactaacttagcagcctacagcttgatatcatcagaagtttcattcctgatgaagagacgcgttgatgagagcaaagctaaactcagggtacacaaattatgctacttcatgtttactagtaagaagcagactagcagctcccacttcctgactgaagttgttttcgagcatgcgcgtaaagactataagcactcagagaacacaacattcctattaccacatctgaagattgcagctgatgagaaggtgagtcacagtcgtatgacaagtttgctgctcaagtactacatctctcacatatacggtattggtgaatcgtgcaaaggttgcgaactcaccactcactctcctttgcctaaatcgctgaacataccagctgctgagtttcctctcaccttagaacagcgtaaacaagcacacgccatgagaactgctcaacacgatgaggacgatgatgatgatgattctgatgatagtgaagagatccctgcacttgagccactaactccagagcaattagctgatgccactacctgccttgctgagaaaacacgtagtaaatatttagctagagcaccaggaggatctatgatacgacagagttacttacctcttggtttaaacagccaatcacatgctgccagccaatcaacacctaaaaagaaagtgacgatagtggaaagtgatgaccaaatacctatcattcaggatgactccaacatgagtaagccaacacagaaatggttgtagttattagcctcgtctagcaccatctttggtttcgctcctgcgagtgtgtccggagggtcccagcaatgcccctcggatagatgctgcgttaaagtgataacagac

SEQ ID NO: 171 - DNA, 2092 bp, Unknown
  derived from dsRNAs of unknown virus
gaatataaattgtttagtaattaaacgtaagtttccaaaatataaaaatacagcaaagcaattcggcatgagttctgttgatgctaccaaggattacgccgttgaggtcgcgaagaccgccctcaatggattcaataagcaagcacgaggtgatctggaagcgcctaatggtgatgaaaacgttcgcctgtacactgccaaaggcggctcagccgtgacactggccagtggaacgacctccgccgccgtcgtatttgaccctgaagcgtccattcgcaatggacaaatgaacgtgtgcgtctacgagcgcgataccaacgacgcggttacggccgtccagactgttaaccttgggcgctcgtctaatgagtttctgtccgtaggcgtgatgagctcggggctgaaggtgtttaacagctctggtgtggacgttattggtggaacgcaaactgccgcggtgttaacgtcggtcccgaaagatatcagttcgattacgactaccgatgtgtccaacttctgctctaaccatgagcgtgatgtagctagcggaattgtgtctcgtgaggattcgactatgaccgtcagcatgacagagcacctggggcgtaagatgtgcctttctcgcacagatacaattggcaatgtggtcacgcgcacttgggacgattcagtgtcgacgaggcgtactacatccggtaagactggcggtttcgccgtcgataccactgttacaccggtatctgatagctcggatgacaccgtttctttcgcgacgttattggcaagccacaattcgggtaccaacaagatgatttttgattcgtctaggctggacgacattcacgaccctttgaccctggcaacctataatgctcgacttaagggatacatccggatcaacgcaggtaccgggtctgcttacgatgactacatggcatccttcaggattatgggccttagcgccgccaacgagattgtctctgaatctggagttagagacattactactgttaaggcgagcgataccttcgacttgacgttcgacaccacgttctccagctctgccaagcctattgcccgcgttgtggcgttctggtcgcgatatgtgggtcccgatgtcactgaagccatccgcgttcaggatacggtgttcacgctttctagcttggaagaaactgccgatatcccggcccgccctattcatgtgtgcgtgtttgagggtctcaacaaccaagctacgcttaacatcaactctacggctgtgcttactggcgtgcccgactccacgaacgtgtttatctcttccgctacatccgctaatactgatatggtggatggtaacgctgttgagatgttcctgaggtcagttatcagggggatgcctcgtgcctttacagtcgctggccatgggtccgtggaaaggagcgttgacgcgctttttggcactgaagaggttgcacttaccttcaaagcaatgtcgttctctgacattactaaggggcttaaaaccattgggtcgcgtgctaaagacgccaagcgcgtggctgagcaagcgttgcctttcgtcgatgacgcagctaggattgcctccatgatgcccggtccagtaggcgccgctgggtctatgattcataatgtcacgaggcgcatgtgaagagtatgccacttcccaagtgttgtgtcctctaacggtgacttggtcccaggcctcatacataagataatcatgagtaatcatcctctggatagggagtacaatgttagatatggtttacacatcgatgttaacgtattagatattggccctgcgatgatctcgttattacatgagacggagctcacctttatctcactccatcgcgatgtgaaattagagggcagatcatgggaaatggccgccgcgttaagcatcattggcgtagaaacgactgcatcaggaacacttgaagaggtgagtgatggggtcctcgcatttgggccggtgccaggcattgatgtgaagaagacgctgtctccaaatttattaacttacaatgaactacactcaatagttatttcccggtaactatgagataagcaattttgaaacatc

SEQ ID NO: 172 - DNA, 1333 bp, Unknown
  derived from dsRNAs of unknown virus
gggggtgtgttattagaaaagattaactgtactaagcatcaaattaaatgtgtcaaacaataaattgattcgttcctgttgttctcttcaactgcatctttcatcttctaggtgctatcatctgagctgtacctgctccaatgttgtcgctcctctgaatctgaacatttgctgttgtgatctactgagtagtaggtggctgctgctgaactcgcatagcttgtccaaacgctctgatcttgtccgctatcttaggtcgatgagttataggatctacattgtcctaaggtgagacttgccaaagtgtagtttggtagctgttgccttgtagttggttggcgtaattttgactgaatgtctaaacttgtccttaatacctttgtcctccaaaaggttggttttaaggttgatcataactcaacactgtggtgttgtgatcttagtttgacacgatgtcaaattaacttcttccactgagctagctacgagcatcgtagtcataaacagcgttattttgcgccgtctgttcgctctatgagaataggccttatcctggatctggagtccagattgtccctcttccatattgtgggatatgttcggagaaatcccagttagttgggggctccttcaagttagtcgccggtttgggtttgtgatctttagtttcctcgtggtgcattacgacaggtgccttctttgaatcaaacttgtcttagtggtattcagtaaaaacactagttgacgaatcaacgccatctactccgataacttcgggcatgctttcatctgtatacttgaactaatctccaagtttattcatctgttcctacatgaattcttcaacgatcattccgtagaataagttttagtttgagatgctttcaacttcttttaagtccgtatcatcttaaccttcaactatttcagatttttggttctgaagttccttgatctctttttcaagattgtcgatgtgagcttcttcttgttcgactgcatgattgatctactctaattcgtctgattcagagatatcaacatcatagtcatcgtatgctaaacataccaagttaaaaagcctttgcacaagatcttttggatcatcctggtcttgcgtgagtcttaccaacatcttatgttaaaatgttgaatcacacttgaagttctttgtgaattcgtccatcttttgatcgagtctgaatgaactctcttctaccatgaaatttcctaaataagttattacaacaatactaaaatcttcctgacaataatataaaagttataatcttcaatcggtatttgaaactaattgggctatttatttaaaatt

SEQ ID NO: 173 - DNA, 1010 bp, Unknown
  derived from dsRNAs of unknown virus
gaattacggacgtagtgagcctgaagaatgcagcaattagccattagcgggcacggaccgtttcttaagaagcataagaatgcgacgacgctgaagatcaccatgccaggatttgtagacgaacgcgcaccaacgaaggtcggtgaacacttactgtcactagcgaatgggggagactttagctcataccaccctgtgtataagagcttgaccggaactccaatggacggtttgtcggtaagtgagatgcgcctagttggcggaatgcctgccgctgccacgactgacgatgtggcggcgattttagttccactaagcccatttgacagggcagaggcccttgttggaaggagtgggcatggttggaccagtaaaggattcactgtaatcgcgaattccggaagagacgcggcagcgactctagagagcgggtcacggataaagagcgtgatggccatactgaggaatgcagctgccgacgatgattgcgtaggctcgtggaagactgggatattggcaccatttcgaggtaccgaaacgacactctcagcgggcgcgccaacctccgcttacgcagctggaaactataacgagattcatgtagatggactaccagctatattagaagctgggtccctcccatctcaaagtggtccactacgcgatcatagacagataactatggtgacaccataccacctcgactatttatacgagcccgagagatacagtttcgcggttggcgagacgtatgcacggccgatgatggccttctacttgtcgggacttaaccaggcaacgtatgaagggttgtctgttgaggtgatttattatggtaccaaagtaccgtctgtaggcgcagcaagcgtgttgggatacgctcaaggaactgtgcctgatgatgagctcatgagaattcgctatgagccagttcattcatttggaaggtaaactaaacgtctaggccacgatggccagtggggttcacctagaccgtcgtaacaaacatc

SEQ ID NO: 174 - DNA, 1466 bp, Unknown
  derived from dsRNAs of unknown virus
tggattttcacgtactcgtccgctcctccagcggaaagtttcgtgagctcagctcgaaagctgagttaagtgcttacgcaagtaatccacgtgtctgtgttactctcaacgtcatgtctgacggtaactccggtgctcccgctccacagccacaacccgcgcaaattcaaccccctgtgcctacgcctacccagcctattcctccacagcctcgccctccggcccctcaatctgtgtcaaagttaggaagtgcttattcgcacatgatcggtaagaatcagctcgttaacactcgtgagaatgaaatcgcacatcggcagtatgttgtgttcgactttgctagtgtcgcccaaagcctcgttcctctttatgagccgttctttgagaaacacaaagccatcttcgctcgcttcactggtccggttagcaactacattgcaggcaacttcgcccgcgtgtacatcgctggctgtcttcattcgataattgagtataacattgagccgttcgagagtctctcgatccaagccgcggttcagacctttggtaacgctcgcagtgacgtgccgaatttcgtcaagtccaccgacggagtcgaccacttcatggcgcatttaattgagtcggttcgccccactctgattaaatccaacggtcgtcagttcatgtacatccctgaccttcgccaaactccgcgcgaacctcaagtgatgcagcaaggtttcaacattttccttggctttacaaacgcgaactgtgatatcaatgaggccatctttcagaacatttgttacaacatgaaagaatcggtgaagaatttcaacgtcaagctgccctcggtaacgtccaagactggtcgcccgttctggctgttcgatacctggaatgaccttggaggtcataacccagtcgaaatattttcgtggttcccatttgagaacaacgtcaacgacgacgatgttactatggcatccatcctccattgcacaatgtctccacttctcgcagaggtcgacgtctcattcgagggaatactcgacaatgagccaccaggactcgacactcacgcaggtaagatggcagtcgcaagacccactccaccacattgggagaagcacatcgtcaagcgaatgatttacggagaaaccgctccaacgatcatcgacgatcccgccgctcgcgcgcaagctctcgcttccgcaagctccggctccgtatcgggttcgaagcaatccaagaagcgtcgcatcagtggaaacttaaccaccgatacacacgttattgctgagaagttccgttattacgtgatggattacgcatatcatgtgtccgtgaaccgacaggttccaggccaagtccggtcgaccatgttcggaatgattgcactcaagtagtgtagctccgtacagtcgcacgtagcgtgaaattgtccaatagttggtttgtataacaactggacaatgtcc

SEQ ID NO: 175 - DNA, 922 bp, Unknown
  derived from dsRNAs of unknown virus
ggaaaaattgagaatggaagtgcaaagttttaccccggatcaccccatcggtagggtcggtgtaagaccttccggtcttaagttttctcccatgaaaggtatggtaggtatgaacaagtttgagaaggacagccgcagtttccgaaatctcgccgaagtcctggcgcccatcacgaacctgctcctcgcaagagcgcttgagcagcgaggcatgctcgagggtgagtccttttcctactcgttcgcgtggctggtcggggctgcgacgcacgacgacgacttccggcgctatgccgatgctttgtgtcgtacgggtgttcaggctcgggagcgatcagtccgcgaaggtcacgcctccggcatcttcaactactgggataaggcgtcaaaggacaccctctcggtggcgatgtggatgatcgaggcggcacgggaagccggtcagcttgaagaccgcaatttcggaggcgacgacactgataagcgcgcccccgagaacggtctcaacccgatcgacgccgtcttcatctggctcacgctttgccgcgcgagccagctgggcttcatcccttggtcgtacgccgtcgcaacggtgctgatcgacggagccctcgagctcctcgaattcatcaccgcagctgaacgtcgactggatcttgacgctctcaagcagaagctgtttgagggcgctcgagtgatcgtcgacctcgagcgatccgagcgtgagcctcgtcgtcggtctacccgctcacaattccggggcgaggacggccagacgccgaactgaacgacacctttcatggaaggctgagcgcatattgagagacgggccgccggaacaccaccggcgtgttgctcgcgatcggtaggcgatctcggcagaggaggaccataactcctccggggcttcggcccccttccc

SEQ ID NO: 176 - DNA, 1910 bp, Unknown
  derived from dsRNAs of unknown virus
gtaaaatttagtacacgtgtagaatagtaatgaatgaattcatcggcggtaatgcccatgaagcaaacaagattaaggttcgaaattcttcagaggtcgtttcaaacatcgacactagagatattttcttcagtaggttcattgttagtgatagagttggttgtctgaccgccagtggagccgtcaccgttaaacgcgggccttttgcgaagtatatggttgatgctaaatttgatggaattcgcactctggttttcttccattcggaattcgtgcgtatgacaggtcttaaggttcgttcagcggaacgtttttctatttcagtgagtgaatacctgtcaatgaaacgcatgcctaagtttattaaagtcaaaggcgtttcctcattaaatagcggctctcttatgttgttcaaatgggttgaatcagcaattcctttcgtcacagacgatcctcatttctcagacgtctccttcacttatgaagatgatattagcgctttatcatttctcgaagactatttaacttctttccgtgatctcgatgttaactttatctcaaactatccaaaaggttatgagataagaaatcgcgtgcgtgatgcttttatggttacatatttgaattcagttgaatccagtgtcagtaaatttaagcgagacggcgaaacttattatggtaagttcttccatgttgttaatggtaggtctgctaaagtaggaataaatatctcaggtcactttctacgcgcctctttaaacggattctttcttagaggattaatgaatcaaatagccggtggttatcactacatagcagacttacatgccactatgagtttagaggtttacttaaactccttcaatacttataggtgcatgtgtacatgtggaaagaaagaatcattcacgcatttggaggacgtaggtgacatagttgttcttttgaaatcgaagtgtttcttagattctgagaaacatgtccatcggtccattccaaattgcataggcgatcatcatctttatgttgtatacaataggagtcctattttagttatcaaagacatagtgctgaagaaaatgatcacttaccataagtatgttagccgattcttgaatcacaatgctccattcgcttggatagctgatcgttatgtgtgttctttaggtttctcagggaaatcttacttcacgaagaaaactaagggacgaatgttaggattcgatattgttgacgctgacgaaatcatgacttggcctggtgtgaaattttggaaagataaagagttgcatgaatatgtacaagtcgtctgggaaaaacgtatcgttcaatacttgtataggcatcctcgtgctatagtacttggcgcgcttaaacctacatgggtgagtaactgcgttaaaatacctaggactttgtataaaaagaacgtgttatctagacatgctaaagagccttctcgaattcagtcaagttttgaaggagccatgcgtcagtatgatgattttcatattagaattcccaaagatcagtggtttagcaatttcgaaagcgctattaaggaaatagcgtctcgtatgaaatataatgttcctccaaatgaaacttctggaattttattatcccaagatgattatccatatcctttgatgatgtctaaaacttcactgcttagcagtacgtcttttgaacctcattttgtcgatgcgattgacacctctattgtttctcaagcgtttgaggaaactatcaaacctgactaccaaccattttcagctactattaatcgtttatcaaccttaacgtcaggaggtgctgacgaagaaaaagaatctgatccataagcttcatattacctttctttctttacaagaattctacataaccaacgtcgactaaaacaaaacttt

SEQ ID NO: 177 - DNA, 1722 bp, Unknown
  derived from dsRNAs of unknown virus
gtaaaataaataaaacttaataaatttctaattctttaaaataactctgtcacccgattcccaggtaattttacgattatacagagaacagagcaatagtaacttaaccatttatcaaacatatggcattcaatttaactccaggtactggcagaaataacctaaagccagcaatgacacctatctcgcagtttcaaccgcagatggagatgtcgaactcaggacgacaagcaaaagttgtccaaagtaacgcgaacgcaagtactaacacgaaaagtggccgatcaggaaaacgaactggtggtaaagtcactcgtaacaagtacaaatcttttgatctaccagtggctgtagcgcccaacaatagacagaactcagcatcacattcgtcactaaatatcacttcgagtgattttggttttgacgttaatggttctgcatctcctacaccatataatgacaaaagagaccaaactttattcagagattacaatcaacgttctacattagaggatggtgataaccaactaaatacgaacaatgtaactaactctttaaagttacttgagattaacctcaaggacagtctttacttcccaggagcttacggcgaagcgtgggatgttattcgaaactgtattactcgagatattgtctcgaacactaagagcgcaaaaggtgcggtagatctaattgatgatatcgttaaatatttctcaagtgtcagctcagcttttgacttactaattgagttagaagtaatgcaagcttggagtcctagttcaaatgattactataatagatcttatagagcattagctgaacttacgactactcctgaaattttagaacagcgcgcaagacttagacaagcattaattcctcatgttttaccacttgagtggatgaactacattaaatgggttcgagaaacgaaattagaaaattcgactcctgaatctgtaaagcaacgatttatttcctcgaacggtgctttattaatgaatgcggcattcaacggtgctacaccggttgattggaaagttgaagttgataacacaattcaagctttaaacaatctgaattcccgaattcctgcaacacttcttagcaatgttaactctgttaaccttaagaacgtgaaagaatactacactggggtacataactcagcagtctttgacgctgattataatgatgtgtttaacaaccgagttatatactgggaattaccagatggctcaaagatgcactaccctaaacgtattggtgaaccatgctatgcagcatttagttcagaaactccaatttccatggcagtagcaggtctatttagacagcgaggaggctatggtttacctattgaaggtccaccatccactgttaaagttggaggtcaaggtttaggacacaacactttccaaattacggaagaagaaagtccttctacaggtagtacacatactatccgtggactagagaagtggtatgagtttgtagacaatacaactcatattattgacatcaatacagatggaagtattaactatgcaatatcaactcctaagggtactgatgttgttagtttcgttgcagatacatctaacatggccatggcagcacgtgaatcattcacatccatgactttaagcggatactaatgcaaataatagttttctcaaacgagattaaccgaaagggcgggtaagcgttcgcgctccc

SEQ ID NO: 178 - DNA, 2148 bp, Unknown
  derived from dsRNAs of unknown virus
  misc_feature (404)..(428): n is a, c, g, t or u
gggtaataccagtgaagtgctgtttgatcctatatttaatgacctatgggtgaacttatatgtagagtacacttctaatggtgtgacgtatcagcaagaatcatgtgctgaggctttcgcccctgctcactatgttactcgcacaaacaaggaagatggaattatccttgctttggcatcgcctaccatcactggggatggtaactctacttctttcaagccgattcttcaagatacgactgacgtagtgaacgctacagctactgtaagttctaactacacgtattggattaatgatccaacaggtccattttattatgggtacctaggatcttgtttcaatgaccctgcgatgagaatgtctggtaaccttaaacaaatgcctgatattaatatcgtacttnnnnnnnnnnnnnnnnnnnnnnnnnagatgttgaatgtgaagccgcatggttgccaattgtgtacgagtgtctccaacgaaacatgtaagaagagtctggaagattacttgttagaaagattcaccaagaaactgtcaattggaactggaagaacgaattctggtaatcctaattaacttaattatttatgaacgctttacctttagaggatttgaatgctcatgaagttagtgttatttcaggtaacttgactatgaccaatcatctccaccgaatgcaatcagggagtgaagctacccctagatcttgggagtacgaaacaaccgacccttctgaagttctaactacttggcttgatttacttcgagctgacttgaaggattgcgactacggagatcgtgttctaacgtttgaggaagattaccttcctaaattcggaccccagggtaaactacctaaactagcgtcttcattaagtgatgttgtaggtacgcaataccaattagctccagaacctgaagtgttcaagagtggtaaatggagtaaagccattcgaaaagctagaagaaagtggtttaagaaagtccccgatggcagtcttcgtccaatgggcttcgaaaaggttgtttctaagttacaatccgagtcaaagctagttactaaatccggttacccagcttgggttaatagaaaggataatgttaaacaagctttggaatacgctaataatgggaaatggcgagaatgtccagcaatagttttaacccggaatcaacacggtaaagataggctagtctgggctttccccttttctacaaatattgttgaaggttcttttgtttatcaaattctcgacaaaattagaggtttgaacctagaggaattttcagccttggaaggtttcaatactgtgaaacaagctgctacccgttgttataactatcttccatttgccgttgggacagatattattacaatggacgcttctttcaagtaccatcactcttatcaggtttacagaatattgaaaactgtattccagaaaagttgttgttctttgatgcttgaaaccttgaaaaatttacattctatcgatgtaattgtaagcaagacacaaaagttagtaggttggcatggagtagcctccggttcagtttggaccaatttaattgaaacgttgtttcaaggattattggacatcttctacgacatagtgaaatcactgctttgtggtgatgatgctgttcgtttcttcaaggagtttgtagccactgaattgattgttgaaatgtttacctcagtcggattgggagctagcgctgagaaacaaactaacaatcctaacgactttgaataccttcaaagattatttattaagggcgtgtattctagtgaagatagcaaagtactttctggcatctatcgaacggtaagggctctgtgttcgatactatttcctgagagatggtattcagatgggtttaactcagatgtattttgtacgcgcgtctacatgattctggagaattgcgtagatcatccctcctttgagaaattcgtccggttcgttgtggtaggtcaaaaggacctgataccttttgcaaaacagtcatactctaagcttcaatcaattgaagcttatgcgaaggagtttccggaattaaacccttcgtatataaaggagacaaagaaaccgctacaccgttttaaatctatagctgtagctgcttccatagattaattc

SEQ ID NO: 179 - DNA, 1768 bp, Unknown
  derived from dsRNAs of unknown virus
agaaattcttttctttatttaaagtttctacttaaatcattgtagtataaaatttcgaatgtttattattattatatatttattattctcagatgggggacaattcaaaatgaacgcaacagtatattctatctgatcttgagccatacgtaatctgttccgctctcgttgatgatattaaaagagctgttcgcgcggcaaaatcacggttttataactataagttaaacaagcaatacattagttctattaacgatacaggcttgaaagaatcaatgatcagatctattaatgatcgtaaggatcaaatatttacattagcattgactcaagtccatacttttatcaaatctagatgctctagagcttacaaaaagttgttgattgacccacttactctagtcgacactgtgtctccggttgttctggatgataagattgctgctgcagtcgatactttaagcgacaatgagtcaactgaaatcggtgctctttttatagatgagaaatatctagtcgatgcactcgttcggttattcataaattgatttggcccttatggtacaattttaaagcctgtgattcctacatttgacgatgttattaatgatgtcaaattagaagcaaatatgggtgcttgttctcgactcgttaggttaggaccaaaagcccattgcgtaggtattttaaaagattcattacataggaattttcttgatgatgacggggaatttagattccaattatctcgacttcctatattaatctttacacgactgcaatttaaagttaaagaaattaagactcgtttagtgtttgcatatcctggtgaaattgccataatcgagtcagctttattaaagatcgttgtttctcttatcgatggtaagaatattaatgtttcttatagcagtggcttgacacagcccgatgttagcaacaaagtcaggtcgctttatggtaaacttaaagctagtctagatgcttcaggctttgatctaaactatcctgccttttatcttattttattcttttgtgtgttggaaaacactatatttaagagtagtccagtagctcgtagaattttaaaattcttatgttgatatgcggtaaatggtgtttgttatcataaaaattttggaattattaatcggtttggcggtcttatgtctggttcaggcttaacaaatatgcttggcacgttcggtactgtgttaaatggttatcttgttgatagctatgttaaggactttaatatttcttctctttatgggagtggtgacgatttatgtctatcatttacaaatgttgtttgtaaggatgtattagctaaattctgttactattccactctatttagtaacttttcttatggaggtgattctcaagtcacgttaccagcagttaatactgttgccttcctaggatctacttgaattaatggtttacctaagcgtaatgtccaacagttactaaatggattagtagtaagtttaaaacagaatagtgttcacaattctgttttaaagcgtaatgttcatgattacgttattgcggttttatttgaaacaggtcgttatcactcgtcgcttcagagtgtttatgagaatttaggctacaagcaatctgactacgttaacaagagtgttaacatctacgatcgaaatccgtcttctttcgttactaatgttgttcgtggcatgaagatcccgcgagatgtaaattctgcatgaaaatcatgttagaggggagcaacactcaaaacccc

SEQ ID NO: 180 - DNA, 1564 bp, Unknown
  derived from dsRNAs of unknown virus
gaatagaaaccctttcctacgatacagactatatgttttccgagctttcactaagtgtgattcaaagaccaaaacgtgatggttttagagctgctaaatttgcgtatatcacaaacctccatgacccagcggcacgaactcatgagaccgaaatggacgggccgcaagatggagaatttgatcccgcgaaaatagatgtgttagctaatcgtatggcggcttcaacaacacaagtacgtaagcatttgtcaatgattcatcaagcaatgcttgagactctaagtccaggagaaacgaaacatattgctgaggcggtaaagaataagaagcgtatcgatttgcaatcgttactatgcactggtttagcgcgtaatctatcaaaagatggatatgtcctacttacggatgaacttctcctgaaatcagcgggaggtgttgtttacacggagccaattgttatacaagaagtagataacttcacgcttcatgtagatgtgccatattctggcaccgcaaggatcttggattacgctacatctccagatggcattccaagagtcaccccaatcgtaacggatatgcgtatccattcaggaagtaatgaagtaattatcagctctgcgatcactcgcgatccatacgcgccatttggcgctgttacgacggcattgaacgtacatacgatgggcacagctttcaatagattggtggacattcttgaaaaagctgaattcgctacgattggagacagggatcgatgcccatttatagtggaatctggtgagttaggcgatggcacaattatcattcatgcattcccacagattgatggttccgcccttacaaactggatggaatacagtacacagacgatgaaacgaatgctaacctcgatgcttaatacgttatcgaataaaatgattccccaagcctatacagcgactcgtcttggtggtcaatttccaattgatttttatacaatccttggcaattatgtagatggaatgaatggcatcatgcaacctcgaaaaacggttaaagcgagtatacaattagaagaaatcttaacttcttattacaactgcgcatctaccggtaagatgaatgatcgtatgcgtaatacgttcaagacgttgaaaaccgggaacacacccgataacctaagctacatgaggcaatttatagaatcatatttaacgtttacaattctattcggcgtttatgatgattttgctaaatttaatgctaatgttaacggtgtacaagatgtaaagcggcaagaaaggtgcggtgatgtacttaaagaattcaaagttaaaggcgaatatgcacttgacgaattcaggaacatggcttcatcaatgctaactgacctctttaatgcgccaaatcgtgccgtacatctcactaaactagccgaagagtgctcgaaacccattgcaatcgtcaatgaataccttaagaagccgaagcattaaagtctgacgagcggtgaacagttggtgacgcaaccctaaacccgcatctatagtagggccggccgcggcaaagggtggtaaacatc

SEQ ID NO: 181 - DNA, 1396 bp, Unknown
  derived from dsRNAs of unknown virus
gaatattattgcgcacatcgaaattaccaagaaatgtctaataccgaagtgcaacgtggtcgtaacttggtgaaaaggagagtgactggtggacaggtaacgttctccaaccaagcgactgcatcgccagcgaacggtcaaactgatggtggtctcgacggcaatcaagtcgattcaggcgaaccgagctccccacctcctgaaacgcaggaagagtatgacgctaggagaaaggctgagatcgaagcccataaccttctagatgaactcgggacacggctcgcaagcgagattgcggcgtacaacgaggaacattgggcagaggaggaaggatcagcggatcgatatgggattaaggatttacatcgtgacacgttcactacagtctttgacccaacgcgggctgctcgtggagaagaggggcctatgactgatgaagagattaacgagatggaaaacgctgcacttactctatcggcgataatcgattccatgggtactgtcggtggttttagcagcgatccaaaagttaaaactaaagccacgcgtctaaataatataagcctcttcttgaataaaggagtagatatatcccgagcattgaggtcaggtgatgtagggaggatgtataatgagatgggaccatttggaacaatcagggctatcgctactggagaagggacgggtcagactgatagatttcttactacatacgtgcaagcccctggcgcactgtttactggtggtccacaagcggcaatcgatacattgttggtcccgggagttaacaagcagcaagagaagccattcatccaaacgattggtgacactttcactaacgtcttctccgctgctagtgaatatgactcctacgccgataaaatcgcatccaagcgcggtatccgtatattggaggaggacaggtactatgtagtacgatatgacccacattatgacatcacgtatgttgagtggaggcctaccacggacatcaaaaacttgctgacgcaaaaaggattctctggagcggtaagggaatggtctgaggatgcactagcagcgcttgggtacaaggtgccagcatggacacgtagggtgcaacgcgttaaagaaaaatacggagaagagagtgaaaaggtggttcattatggctattcccgagggggtggtcttgctactcatatgggtggaactggatatggaaccggttacttctcacgttacctgccgaaacgtggatcaaggtctaagtatagcggtgacgtcattcatgactatctaatcaaccctctatcagttgctctattatggagaaatctgcatagagtgtgacaaatgaacattcttgggcatggtattctagctgccatggtcgctgtgctcaatatgaaacatc

SEQ ID NO: 182 - DNA, 1670 bp, Unknown
  derived from dsRNAs of unknown virus
gggattttttgtaatacatgcggaactaactgttgactatggatggcaacacgttgttaagtttcgaacagtttaatgctctagatgagcgtgataagtatttaaactatgtgagagagtataattttaagaacgctgctaaagctagtttggctactgctgagcagtatggattaaccagagagcgtaaggctagaagaggattgctccttccatctggatttggtgatttggaaaagttggatcagggtatgatcattgtgatgttaagacaagttgagaaggctgatgctaccaatgcacctgagttgaataatttgatttacaatctgagagaggagtgcaagtcaaagagaatcaactttgttgaattgaaaggcttttcatctgatgacctcataacatctactctgaacccacttagtaggaatgatctgtgtaaatcttatgctttgatggctgacctactttcagaggtaccacctatctcgagggttacactcaagaccatgcccttggtcgataatgattgcccaactccactaaacaatatcacattcacaaagcacgaattaggacaggtatctgaaactcgctaccacaagcactctgcttccttcgcttctcttggtgaacttcacacacttcagcacttagatgttatgagtgatgagttggcagtgtataatcttggagtggctggtaccatgtttgactgcctatacagagatgatgagaacaaggttacttcatgttcaagcataagtaattggaatagtggtgtatctttctgctccctcatgcccaggatgtcgaagaatgactctgttcttaccatcgtgcggagattagctggcatacccacaatggctctactgtgtacagactcagatgttaagcatgtcccatttcatgttggtagggccattacatatatgctgtcaaaatatgctatctcttcttggagcataggatatgatgaaattggagctcccactttccatttccagggcatgccagatgataagcctataccacgaagctgttgtgcaagaccgaaaccagtaaaggctcagaggcgcatcgacaacaacgttggtaaacgtcactatcatacctggcgtatgacagggaatgccactgggaacactactacacctgtcgattgcaccatgcaagggagaacgcctaaaggaaagaagaagcagcgtagttcacctaggaaacatgcaccacaagagcaagctgcatctttcacttcacaagtgttgcactatgaggcaatacggaacccatgtcagtcacatggcataagcagtgtagtacagacgcctttcactgcagaccttagtgaatttccacctatcaacatgtctcttgatcagatgattagcggtgacatcttcatggcctcgcagtcattcgctcgtttgcatttctaattcttttcaacctaacttctatattcagtatgtcctctcgcttaacatactggcctgcattataatacctgatgagcatatggatatactattgaacaacgggaagtccatagaatctgttagctcttcgcgcccggctgcaaagtctcttgactccagagggggagagttgcactcccttctctgtggtcttgagcgcatggcgcgcatggaattatgatacagacc

SEQ ID NO: 183 - DNA, 2886 bp, Unknown
  derived from dsRNAs of unknown virus
  misc_feature (853)..(861): n is a, c, g, t or u
gaagtaaattagaccaagagaacgcacatcatgagtcgcaacgacaggggcagaaataacatacctttcttacagacagatgacgatacagtcatcacggctgcaaaacgacaggtccctgaagtcagagaggcactcaatcgattgaacatgcaagcatcaagaagtattaatgatgatgggagcgaatctaggatgatacgggagttgctcaatacgctccagaacgtgggcggtgatatgaaaagccacggcctagccattaagatgctggctaagtggtcaggagaagtagaacatttaacttcagaaatgaggaagagtgttaactcactcttgagtactagtacatcacatcatgttggcatgaatctgcagcggagactggacgcattcgtttcgctcttagacccggagcacagtaaattaggtgggttgacacttgtcgaggggccaataaacacagttgtaactgaatttccacagtctgtgacgtttaaggtcgctaaaggtgttaacttgttaatactgtatttaccagcgctgattgagcaatggtgcgacaacggctgtcgaatctacatcgaacagtacaatttggattcaacgactggagtaaaaaggttgatccgagacgatacaagcgatgttatctctacgacggcagcccgatgggggcatgtgtcatcggccatgaagatcgttaatgtaagtgcgtcagatcagacacagggtggtgcatccttagcgtgttttgcaccgacaacagaagcgctagccaatctaaccgtggataatctattacgaagcgtaaggtgtacacaggagaaggggttctattcgacggcgcagnnnnnnnnnctcaaaatcagaaatgatgtggatacaagtaattttgatccaataagtgttgggcaaagtacgataaacgctttcgtggatactgacaattacatatggcgagtacgtggtacaggacgatggaatgcaaccgatacattcactgcgtgcgagacgcgtatgatgccattagtgccagtgtccccatgtatggacggagcgcggcaggcagcaccctatctaaataatcaggaaattcagttagattgcatgctggtaattgaaatactcgatagaggtgagggggttctagtgggcgacttttgcacggtagcacctccggtaaatgctgatgtataccaacgtccagcaaaggcagttgtcactgaagtaacagggtccggtgagattctaaaggtcatgttggtcgatggcggcgaagggtttgacactatagcagagcaacccggcgcggctggtccaactccaatcaccactacattagctaattggacatttacgaatactactaacgtctctctattacccgaattgagatttagtgcgcgatggacatcaaataatatctatacaggcaccggagaggtaagcgccacggtttctaatgctacgggtggatactttggtaggtgcacgcctgcaattatgcagaacgtaacctactcgcaagggtcttactatggagtgtctggagacatgatgaactatcccaatgagctggacgccctatattatagacaggggccagctatgcttaataccaacaaccctgctacaaattttaacgcagctagtgctaacgatgtaggacctttcccgatagcatttaatagtacgaaacctgggaggaatatgatatcacttggtggaatcgacttcagcgcgagcgcagacagtgaacccatccgtgggttgaaattccagatatctggtaatatcagtcgggcagtatgtgataatagtattgatgtggtgaccttgcagcctacgataaatcccgatgtgacgttggcgggagaagtaaagtgcaatagtaacataaataaagcatggcttgtcgtatttgctgttgctgagggtaagaatggtgtatcgtttggtatgccatataactcgagtaggcccgaagatgtgatatatgtgcctacaccatataatcccaatcaggacggtgtatacgatgggggaaactatggattcgctatctcagatgattccaccgattctagaacgccgtcaaactatgccgtgattccgttagggattgataggaatccgcctacatcaggaggggatatcttcctacggcaggtgaaaccgaaccagtccttctcattctccattgagatcgattgtaccaaagggtatgtagatccagcagcgaccgacggtgtaggaactgggaacgggagatggccggtagcatacggaaagactgatggctcagcaacgcaaggagagttgggtaaatccgtacgtctcaatgacgtactaatggatccaaatgggagagtaaaatggcggggggacaaagtcactaagttcaccgatatagcattttactgtctcgaaagggtacagctatacgcttatgtcatatgcaacggcatctcatcatcactgcaagatatcagaactgatgtaccgactggtgcatcgtcagcattcgtaccccaaaactataattctgactgctgggacataacttcactaaatattgaagcaacccagaggagataccaaaaggaggcacagcaacgcatcgccttcggcgcgttgacaacccaggagggtaacgagtatacggttggtgtgcatataaatgcgaatcagtctacaaagactaaggacattgtagcgcatccaatagatggagaacaggtaaaaatttcagacctagtcgaaatgactcgatcgatgccaaatgagagcgggggggcgattaatatcaaagccccttaactcaatgttttctcttggaaaaagggtcccaacgcaatgggtgtgaacctggtttatacaatc

SEQ ID NO: 184 - DNA, 2777 bp, Unknown
  derived from dsRNAs of unknown virus
gagaaagcagaagcagagactctcccccccataattaccacccaaacaatgtggtcaagtcccatttcttcggacagtgaaatattgaagtcaacagaggccgaggcacagcaatttcaaatacatgagcttacagtaagccaattacgtagcatacgcctgttaggtcaaatagataacattgtggatacaattgaccagattgatgacctgaaagaagttgacgtcggaaagatagtcaatgtaatggtgacagacacccaggaggtacaatcagcagcaatactacatacaaagacagacatggcaacagtaaccagatgggctccaaagtcaagggctgggaatgaggttatccttagatttaagtctggtccgctgagtgctgcacaccggcatgaattagttaactaccttaggtgggttggtgcgtgtcaggagcagatagacgagctggaaaggttgattgagtattgtgatccacgtgataggagtaagagtatacggaaccacaacatatgggtcacaaaccagcagccaaggcggctatgctacaagtggaagatacccgacaagccagcaccgaatacccataaagcagatgcattacgaagagttgagaagttgttagacgacacttttctacagtttcaagactctagtatgctcagagaggcagtgcagagagaggttgagcaagcccacgaccttgcaggctacacacaaaatgacccacgcgatgtgtgcaagcgcttcaaacattacatacagcctaggatcaagacgtttgacactgaggaaatgatagatgcgtggaagattgctaaacgggtaaagatgaaacgattcatgaaagtgaatggcggtaagattaaagtttacaagaggttatctgatattacagcacgtacattgcgcgaagagttgcagagcgggtcagcaggcgaatacaagtcatttggcgtggacaggaggaatgatttgggcatgtgtgcagcagtcgtagagtacttggaacgtgtgcaagtcgaggcagaaagagtggtgaacagcaatgagttatgtgaatcaaacatccggcttaatcctttaacagagctatttggaaaagaggagccgaaggcaaagaagaggttagacagagagataattgactcagtagcaaggcttatatttaacggttcaccgtttgtctacattgtagattttatcctatttggcgaggtctcaaagaggctgaagaacatgtcccaccatggtccagggtatgggccgacacgtggtggaactgagaagcttaagagattcattaataggagctttactgacaaccctagatgcgtgacaacagagcatgatatgactaattctgactacaacaaatttgatgcgtcacttaaggagtgcatactcaaatggaacatggactacctaaaggacacgtatgattatagtgctcttgatcttattgatcaagtggcatatgaaatattacacagggtcgcattggagaacattctgtcaaaattggtaaaacacgtatctggagtacacctatttctacatgggtgtatgccaagcggtgcattcttgaccagtacaggaaacactgagatgaatgatggaatagtaataagccatatagccatgcagatgctccatgacaagagatggtcagagttgtctagtaatgaagttgccgacctgatagaggaagtaatagaggacacaataatttcatacggcgacaatcagatattctctgagctgccctacgtatcattaggaatcaagagagattttgaagacttcgtggagtacgcagctaggtttgggatgacaatgaaacctgatgagacggtggtgacaaaacacttgtcagcatgtgcatattgctcaaggaagccagttaagatgccgaacggagaaattatagtgacccggacagcacagcagtatgccagcaaagtcatgtccaggccaaatgaggacccagttttgtccgcgatctacatacgcgccttgttgtcagacaatgcaggcactgacccattagggtttcagttcttgcaacaggtggacaaaaggatggacattaatgatgcttcaataactgcgaagctgagagcactggatgcggacacgttaaagaagttaaggctgttatacgacacagagaatatggatgtaattaaggtcaggattatgcagtgttcaaagtcaagggcatatgcacttgacttgttgcgtcctctgacaagggatgaaaagaaatatggaagcaacaagttcggcacagacggttcggtcgaattaacacgtggtatcattaggtcaatgatcgaagcaagcccagtaccacatctgttttgcaagactgccacatggtataaatacttaggtgtctcaaatcagctaggtatttactgtgagagagatgatggactggaaggagcacgcttaatatcagaggcaatgttgaaagaagtaacttatgacagcgtagtagagcagatggagagagaaattgaagagttagacgatgagctgttggatgagttggttggcgacggtgccagcgtttgtgactacacaatgtcaggcgaaacattcaaaataggctgaggagactagtgtacttgggtgtattgtggtggagtatttgcttttgcgtacgaaagttagggcatggactaacaaatgggagcttcaggcttcaattgagtcaagtggcgcgaaacacttgactaaattgaagtactgaagactcagccttc

SEQ ID NO: 185 - DNA, 1585 bp, Unknown
  derived from dsRNAs of unknown virus
tacgatgagcaggacagccaacattgacgcagaatttacttctctccacgcacttttcaacggagctcatgagcacttcggagctggcaaaacagtagagatagccaacaattggattcagagcgcctcagacgataaagaagctcggtatcgcatcgaagcatgctgcctcttttatctcaagggaatcaagtacctcttgaaaggagagacaaaagcctctaaggatgctggcaaaacaacctctgctttggttgatccgagtcttatcaagtaccttcctgttcatgcttctatgccaaaatcagaggattccaagcaacagaaggagatggaagatctcaggaacagtctaccttctgccttcaagtatttgaatgtgacaatgatccgcaatgttgcgttcttggcattcgaggctcaggcgtacctgactgattctgattatttcatatgccccaagagctatggatacttcatgaagttccgtctcgggccctcagagatcgccaaagatgtggacaaatacatcactgggtctgataaaactgttgaaattgctcaacaacactattctatgtgggcctcaatggagtcttactggaagccatgcatttcggacatgaagaagcttgctttaaaacgagcttaaatgattctgagcatgcctagggaagagcattaacttgcatggatggcaataccaatctccatcaggcatcagaatgtaaacgctcaactgatctacatttgtggcgtattgcagtgtttgccttcttctaaacacaaatctgtggtcaagcttaaataattgactgttcaaatcaggaggtataatcatagcttctcgggggatgtgatactttgctgtgaaataccttttgaagttgaggttttgagtctgatcaaccacatgatatgctccttcaataatttgatcaaagggcaattgtgaggcatgctctaatatccggatgagatagagaaattcgactgtcatgttgacaataggtgctgagttgaaagtttctttgaagtcattgctcaactgatccaacatcattggtgacgcaagattggtaatgggaagaggaactccatctacaaagtcatgctcttcaaggcattctttctcaatctctataacattctcccgggaatgaccatctagaagatttgcaaaaatcggacaggaagtgtgatctgtaagagcgaaatgattgagctgacgctcgcttaaacgcctcaaacaattcaacactgtggtcatcgctactgttcaacaactttttcaataggtgtctagctctctgaacaattgaattatccaaattagtaggaaattctaattgcaaggtgttaagagctaagtcacaggatttcagatgaactatcagttctgaagagttttcgtaggatgctttgttagattgttttcttaagaatgatctgattttcaatagctgattgcagaaagatcttagttgaatatgatattcttcagacagttctactttgttttgtctaagcaaatatgttatttcttgaaactcgttgttgaatatgtggctgtcacggtcattcc

SEQ ID NO: 186 - DNA, 1637 bp, Unknown
  derived from dsRNAs of unknown virus
ttagataaattgtatcaattgacaaactaaagactgtttttgttcttaacatgccaaacaacggtagaaacaagaatttttagaagcacaagtcttctaattacggttaaactagaaatgagtagaaatctaaatctattcaggaatacaaagattccttcaacgacgactagtacaaggaacaaaaagttgaaaacatcgaaactatgggttagaaaatcaacaaagaagctttaaagaccaagaatgtccaagatgcattagcaaatgtacaaaaggataaaccacctcaaccaaagtaaatggaacaggaaggtaagaagcagagcaacttcaagaaagatgaaaagaattaaagaaatacgaaagaaaagaaacattaatctcaaatctatcagaagtaagcaactgaatctgctattaatcagcacaacatcacaggagtgaaagaaaatgtagctgttgttcttgatcatttaatcacaaaatccatcctcgataatttcgaacacaatttaattcagcagcacaatcgagatgataaaaatcgcaatgctaaagtaacatttacaaaactcgcgaaatgtttaaaagctttgagaatcattatgcagttatttttaactagcaatgttgcagaaggacaaaacagtatcttttaaaagtcacttggcaaattaaacggatataagttgttaagctaccaacaatttgacaattacgtcaacacaattggagatgttcaatttgagaacttcaaatgtgagatgggaagcagagacaatgagatagctaaattaatcatgcttatagctagagaaactcaaatgattccaaatgaaatcagagagagtttcggattcaattcctaagcaagttacagattgagactgaaccaaccagtcattgacaacaacactatctttaacttctagggagtccaagtacgaccaaaactcgtagaagcaatgattgaaagcaagttcaatgccatggaaaaagtaggtaccatgagaatcggaaatgtcatgttcccagcttttgatgaacaaacttttcagaaggttttgaatcttccaggtcatgtattggcttcaagattcgacaatcatcgcaagtttccaaaacttaacgaattgatgatggactggagtagaatcggtgatcaaatctacgctccactaagagcaaagaacaacatcgccatgatttcagacgtctctttagatgatttgaatgattttatgattacttttgttaataacttaaccactattatgtaggaagtatccacaaaggtagatatgactgaagcaaagatcagtaatgccggaagtagaacccagttgttcgaatacagaactggacacatttacggtgaattccaaatgagtgaggaagaaagagcaattgcaggtaagtagaagaatgtcgcaatggtctaagaaactggaggttacaaactcgttaccgacaaaccattcggtgagtttaacgcaggaaaaagacagaaacttttgtatcaggtagataaaggtgcttgaacgtgaagtattgcaaagttcgctgcttaacagccttatttaaacttaatctttaaacttataaagggaattaatgaaccttagttcaacccc

SEQ ID NO: 187 - DNA, 924 bp, Unknown
  derived from dsRNAs of unknown virus
ggtataaaatcagaatacattatgactaccttaacagagtttagagctttaaagaaaggaaatcgtgaaatagatcggaatctaactgagggagaacttttgacatcaccagataagataaccgttaataaaggtgagatcgctacactatgctggacaaaacaacaggtaaaaaatgctctttcactaggagtagctgctcctactgtgccttcgtcgacaacgtcattcttccatcaaggcgacttcttaaattatgcattcaggcaagcattgatcaattcaagaatgttacattcatacgcaaatgcagtaagaactaccacttcatctatgaacgcagctgctgacttagctgtagccaccgtggttgctaatactacaccgtcgcttcgttctataccattaggcgcgctaccgtcgaatctaacagctaggtctgctactctaattattaccgacggacaggctatacaaggtggggcaatcgtagctagtccaggaaatgtcgtcattacttatcaaacggtgactactgcagtaggtgtcacgccagccaggattatattcactgcatctgtgccagcttctcaatacgtaggtagaaagttgatggttactgcaaacagcatttcaactacaccaggtgattctccagtagtcaacttcacttcaagcacaactgtcggtttaatgaataataccgtcccagcaacagcaaacgtgatattttatgctagtgtacgtgatgctgaaaactttccagttatcaatgcattgttagcatattccggtaattaaatcaaccgatctataactgtatttgtctaaacgagcgttcttcaatctgttaaaatagttatccttcatgattgtggacttcatctacccacttgattgattgctgttcggtgaggaactgac

SEQ ID NO: 188 - DNA, 938 bp, Unknown
  derived from dsRNAs of unknown virus
gaatatttttgcttaacttatagtgttatgctcacgttacatcgacagtgcgtaagcatgcctaaaagatcgactccagctatgcccactggaagtctatctatcgaggagacgaggagtgatataacatcacttgttctcagattcgaaaagaatggcgatgtcgtttctcaattagaagtggaggtgaaagaaaatgggaaggtcgagttacttcttaagggagtcaacttcgactggtccgaaccgctagcggatgcaaccgcctcgcttactataaatgaaattcaacaacctgtgattgaagagggctcaccggaaaagaaaccgcgcaaagaggaggaaattctggaagatgtactggctacatgcgagaatctgctagcagatgaagtaatggaaaagcttgatgcaccatccaggcgtgattccttccaggctgcgctagatgcgttgccgcggatacatacaccgagacctctctctacaacggatacgtcattggctccatccgaatgtgaaggatacacttttaacgaatacattaggacttcaatcgccggaaagcggtacaaattgaagcttagaaaggacggtggaataacctgtgacttgacaggcgtcttaaccggtaatcccaattctaaacacgttaaaaggaacgtattcatcacaaaatcgaagaactcattgggagaaatctcaatgattgtgttatccaaagcgagacctaaggcgagtatgcctattgatgcgctgccctctggaatagacctagctataggtaacggtaaggcgtcttatggctctaacccgacaggtgcagctctaggatacaccaacgaagagatggatatgctaaagacaatcagagaagcggtggttttatattacgctccttgaacacactcgagtacaagttaagtagaatgaacatc

SEQ ID NO: 189 - DNA, 1738 bp, Unknown
  derived from dsRNAs of unknown virus
ggaaagattggtcactttcccctcgtgtgtgcttacatgtcttgtacatacaatgaggtcggctgacaacccatgactcgtggattgactagagtctagctttgcttctagcataaaaggagcttccgggccgtatattgcccatccaaaaattatacaaaattaagtgcaccttaacaacctatcatagaatgtcaacaaaagtttatggatcgtaaactttataggcaactattttgagtagttaagtgtggtctagcatctaccaacctgtaacgcgggggatgttctgcatgtatcttcggtgcgaatccgaggcatggagatattccaaaataatgcttgtgtatctagtgattaatgactaacttgaagctttaatctactggtgaatcacgtgtcatagtaataaggacacaaacctaaatttctcatggataaattatgataatgaatacattaacagatattgttcaacccgtccaaagtgaggtcttaattggggtcctacctgatttaaaatcttttaattttgtcgcacggaattggtacaatacctatattgcgtctttaccttcggataaagcgtggaatcaagttcctgacagtgatacgtttgtagcatatctcaaagtatgcctaaggctgtatattcactggtctcacggtcaacgttttaacgaacgttttagaaccgagagtccaacgaagctccttatggctagcggagatgtctatctacctactttcgctctccagatggttcgagagaccgcgcgtatgatgttcgccggtgatgcaataatttttccattcctaccgcttgatagcaaggaaggcgatggcttagtaccgggtcttggttttaataccacttacagactctgttcaacagctttcaaaaaccttggttgtcctgcgatggtccaagagaattgtgggtgcgcacctatattcgtcgcgaatgatgtaagcatagtttggtctaacggccagacgatgacccagagtcgtatgtactcggtcaatgctcttcgccatttgaatagaacgtgtgaactcctacatggttgtactacttatgagagaaaagctgcaaatccagcagtcgttcaattagacaccgtctcgagtttcgaattcgaggtatcagaacgtgttgaactgaaaggcttagcagaagcaactcatgagtattcgtggaatggcactcgtaaagagattcaagctatggaagcaaaggactacccgtccatcttaccagacacttattttatcgatttacgtagacgcctacatgttaacgatgacgtgttgaatagtgcaaaatttgcacgcgtcaactttaacttttcttcgaaagtatttagggtcgatgctattactgtagcggttagcactgaacttaaatttccaaccagctcttacccatccgtcgccactaccaaagccattggtaaagcaaggaaaggtaaaaagaaaggtaaaccaacttccaaagatgaaactgaacccgattagatcaggcattagccggtatccaatccgagggcacatttcgtctcatttgagaacgggggcctagtcagccagagaaaagacttaacccatgtcacgggggggaatatgctactgtgatgtcctagtatgccaggagggtgacaacaagccaatgcataccacgttagtaactacgtagaagtgccaatacacttaaagtgaaaatcttacgagacca

SEQ ID NO: 190 - DNA, 813 bp, Unknown
  derived from dsRNAs of unknown virus
gggatttaaaagtcgtgttgtcgttatcatagcaatcatgttggcgagacgcattgtagcagctattgatggattatctctatctacaataatattatttgattatctcattcaggatggtgttctgcctgcattagtgtcgaagtatgttacttcaggagttgctgcactggttaccgttttgcacctattcatgtacgctgcgggatatgaccttaagttagcgaaagagcaaatgaagattgaaagagattcgaaggatcatggcattgcacaacttgaagcagcgaagtatacacctgcaaccgcaccttctcttaccaccttgaacgtgcccgcttatatgcatgaatacatcaagatggataactcagtgcaagctccaccctatagtatgcatcctcaaactgactacccgcagaacatcgtccacaaaaacaagtcaattgatagtataccaaagaaagtgagtaatagtagtaaagctgtgttgattaacccctcgaggaacggcaagatagtaattaatgggaactagcgatatttgcgccaacaaattgctagcagaaaccatgactaggccgactctctccactcctgagtgactttggctcaggagctaacacgtgtgcggcgctggggagggcctgtgtcacaccttagtccaagggggcaggtgtgacatctaatgtgccctctttgccaaagacgcacgtgggtttgagttgcgatcatttctcatggtgaaaggtatagacgcactaaggctatgaggtctggaacagcctcatagctgatgaactttgacagacc

SEQ ID NO: 191 - DNA, 749 bp, Unknown
  derived from dsRNAs of unknown virus
ggtataaaatagctgaactttaacatcttatctaagtactttaaataatttgtatcaggtcgaaatgaacgcttcacgataccacgtaatatcaaatatccaggcgcccggctgtaaaaatgaaaaggtaatttgtttacacaaggttgtcgcaattagcgtgatacttatttcttcaggattggcagtctttaatcaaatagcgcaacgtgagtttgacactgaaacgtactttaagatatctctcatctgcgatgcagtcagtaacgtattgataattgcattgtcaataataggcatgactgctcggcatactccacgaataattaatcaagctaatacgaataacgctgatattgaaatgaatttattaaaccaggacgttaaccataaggaacaaaactttaacgtgagtaattcagagcacttgaacaaatcagacgttaaaaagagaggcaaacgtatgacttatagcttcaaagatgggagtatacgtatttcagagtgtgacacaaaatcagaaagcgagaatatcattatgcctactgcacctcaactgaaacgcttagtgattaaaagtagttataatggtaattcagtcgtgcgggataatgagacaggacatgaatactgtatcgacactgatttagctaaactgatgttagaaggatgagttagttaaagttaacaacgatgcattggtagatctaccaccgccaatgcgttgtgcactatttgtaaaccagacc

SEQ ID NO: 192 - DNA, 1112 bp, Unknown
  derived from dsRNAs of unknown virus
gaagacttccccctgtactacgcacgcggttacgcggtgcccgaaccgccgcaagaccgtactgtgtgtatagcatgacgggagggccgatcattccatcgccaccctactttggtgcggtcttcgagaccgcgtcgccgtacgccgaagatcctgggtatgccgacctgaagaacgtctttgtagacgatccggccatgacccgcgcgatggaaagcgcagcggggttggcgacgacgaatcctaccgcgtccagctcggcggttgtcgtgccattccaggcgactcatccctttcttggtccgagccggtactatgcggtgaagtgtgagagggttggaaacaaccccaacaacttccatctgcgaaatatgcagatgttcccgtgccgtggcccgccgggcttcgaaatagacagcatagtatacgacgaggagtcgggccaatcgggggttcagcgaccgatgcctctttcgttggaggtggatcccgcggcggggcattttggcttcgcggccgcgaactcgacagcgaggatggacggtagtgccaacttcgcgaggtacattgcgaatgtgcggccattcgaaggagtgttacgggagtgcgacacgaacgaggcgcgtgcgatgcgtatatgccggtcagtcatatcgcatctggcgcacggctacggcccggagaatggcgtggacgatatcacgctggataattacatattcgttaccgttcggtttatcaacgagttcgacgaagaaggcaggccgcgagagcgatgggtgtcggtgaacaagtaccgaacggccgcgcagccagatacggaggtgtatctaatgtgggatgtcaagtttccgaacctggaaccgaaggacacacccgacgacaacgaggatggcgacgccagggtgcgaggcatgcgcgcgcgcgagttgcgcgtgggttacatgttcggcggctggaccgcggccgaatcgtgggtcgcgacgagagaagtcgatgcagatcgtacaagtagtttagcagtggttaagcgcaacgagccgtttgttacggctgccgcgcgtaatctgattgggactgaaggtgtctgaccgtgaggaagtgtaaagatc

SEQ ID NO: 193 - DNA, 1389 bp, Unknown
  derived from dsRNAs of unknown virus
gaatattttgcgaaacagtgttttgtaatattataaagtattattgaaccaacaacgtttgcaatggaggacttaattaaagagataggcaatcagcaagtcaatgctaccgtctacgagggtgggaaaattgacgtcgcgattgagggagcgcatgacgtagttaagagtaaattccccgagttattccaaggcgctgaagacatctccaagtgtgtcgcaaatcccgataagttcgctctgactttaccagcgagaatactaatgtcgttacttgcatcttcaccaaggacaaagcatgaaaaggatttgttcaagaatgagcaacgtttaatcgacgcaagtgagaaagcagcacaaagggcaatgaaagctaacgacacgcttggatcttacaggtccaagtatgaatcacttgaggcgaaacacttctcgttaatgggctcgctttctacggctacgacgacacttgaatccaggaatttgatgaatgaaattcatatctcacgtgaatcaatgtcagaattgaaaagagcgattgaatctgaaagtcgcgctctatcgacatactatggagacgttgatgctgctgaagggcaattagtaaagctacgctctacggcaatgagtgctatgtacgatccgatgattctactgttttcctcaattggtgttgaactacccagctcgtatgactccatcaatgtgtacgaaaggcgagctatcaaagacgtatttcagactaagatattaggatacctgtccagtttaactggaatccaaggcggatctacaaccacagaaagagctatgtttcctaaggttagttcagtgttcgcgccgtcaattgaaatggattttaacgaatttaagtcaactgaggtgtcaagggtgattcagcttgtctataacctagcattggaaatggaacagctaaggagagggtcgggttcagaattccagcgagctacaagggtatacgatctctcgaatgattcagtcattgtaacgtccaaccccttacaaagggaggttcacttgcttaatcttattacactcgctggctatgaccctgagcgttgggcacaggcgtttggaataccgataagtggaatcgggaaacaaatcctgaacgcatggggcggaggtagcaaggggccgttgaagcctgaggatattcgtaaaatcttcaggggtgatcgtgatagattgccatacggactagattacacatctttaagctactcctcaagagtcgaagaacttcaatcaattagcagggatgtcggccagcccgacgtcactttagctgatgaggatgagatagagcgtattgatgagtaattagaggagtattactttacccaaagttttcgtgaatgaaacatc

SEQ ID NO: 194 - DNA, 2233 bp, Unknown
  derived from dsRNAs of unknown virus
ggggctgagggtcttttgaccctcagttgttggtaagcattggaccaacgccaccatgtctcaggcaccattcaaaccttgggagagcacacaaaggagataacatgcaacaaattaacctaagcgggaaatcccgccgggtgcgagttggaccttccttccggaagatcgtaaactctttctttgaagccgatattgagaacatctcgaatcattatgagaagatcgcgaacgcctatatggtaagtaacggtccgagatggacggctactcgcttaaaggcatactacgatttcgcaacaagactcgttcttgaactcgataccaaagctattcctttttgcaggatgaatcgtaatgggatccctagggacctgttgccgatgattccatttctgaaatcgtctaatatacggaacagaagggcatgtctgactttgctaaggtcatacacgcaaatctattgccaagtatcagatgatacaacaacgattacgaatcaaaactctgcagagcgaactctcggtgagtttgagcagtactttgatataattatcgcaagatacaagtatttcctaaagccctttataaacgatgagtcaatgtttcagacaagtaagaaaggacctaacggtccagccctactcaacctagacaaggacttgaagtctattgagagcaatggaatacttcaaaccataatgcagatgcatgaggctgttgaaaaggttaaagtcggtcagagtaaattagaagtaagtttaaagcaggatttgtatcctgaattagatctacttgtatttgaaaccgatagacttaaatcagatccacggcctgtgcggaagcaaggtgtaattgatcatgttaggactatgagtgaacatgcaataaggttcgaacctaatagatataataaatgtattgattccaaaatcagctttatcgctgaaggtggatgcaaaacaagagttatagctataggggactactttacgcaagacgctctgaagcctttacataaatctttataccgttgtctaaataaacttaagacagacggaacgtcatctcacaacaggatttctaagcttgttaagagtaagacagcattaggaggatatgtctcgtcatttgacttgacatcatcaaccgaccgctttcctatctttatacaagaaagagtcctaagtggtttgtacaatcccgaaatctcgagtttatggagaaaacttatggttgatagagatttttctgtaggaaagtcatcgattcgttatagcgtaggacaaccaatgggcttactaagctcatgggctgcctttgctttaactcatcacattaccattgaagccttagctttaaaggttgggaaaccttcttttaaggactattgtatcattggtgatgatgtgactatctttgattcagaagtgtcgaaggaatataggagattcctcaaccattttgagatacaaatctcagagtcaaagtctttagagtcatggggaaacccgtgctctgctgaaattggcaagagactgttcttaaatggtcaggaggtatcacctataccccgagacgctattgaatctgcagttaacaactatcttcttgtaccaaatttaatcaaagttgccttcgaacgcggtattgttagtaataacctaccacaacccgtccaagatgtctggtcggaagtgttccctaaagggaacaaatctgacaagatacgtactctgatcttctatccgctttcagagccccaatttaagggtaactcagaaatatggagaaacttcagcgtgcaccttgttaagggtgcgtttgatgaaatcaaacttgcttacgtcaagaaaagggcacagagcctatatatgaatgaattaaacaacattccaaatatgggtactctagggctcgtcttggaatccgaggagaaccctgatatatcgaggcatccctttatgtctcttcttagagaatatagaggagtatgcggaagcatattcatcggtatctccaccaaaggattagaatgtagtgatttagagaaattaccgtaccttgttaacccaatggtaccctcctttgtgaggcgtagtcatcagattgagaaagttaggtcatctctaattcttaaaacattcgagaaactcaatatagaatccaaagaaagttagtaactcttccaatggaagcgggtccaactgagggtcgaaagaccctcagcccc

SEQ ID NO: 195 - DNA, 1723 bp, Unknown
  derived from dsRNAs of unknown virus
gtaaataaaatcagcaaattctttcccgtccttttaacgaccgtatcgactaggtctggttctgttacattaaaagaatttcaatgtactattttgcataaacatgatattatggtaaacccaagctttatcaatcctatgccattgcgttttaacaaaccgcaaggtaatattagtcctcagctcagaccagctcagcttagactagctgatgcttctgttaatcagaatacacgtactaactcaaacattgcaactaatgctacaggtaaacgtagaggtagaaagactaaaactaaaacagcgaatccaatggattacacagcttctcttttcattggtaatgatggtgacagttcttcaagttctgacagcttcattacagaagatagacgtagtagttttccaattgattctactcgtagcgatagcgttaattttaattttccagttaagacagttgttgatactgttactgacgattttctttatcgggataatagtcaagctagtgttaaacagcatcttcgtctttcacgatatctaacaacttcatcagactactcttcacttaatagtggtagtctagttagagatcaatttagtaatgcttacgatagatggactaccaaaatacaagaagttaggatgaatacttctatgtacaatttctggaacatatcagccgtttacaaatacatttggtatgttgtacatggtttaagtatctattgttgccttgatagcatattagctattgatgaaccggctggagaagttaacagagttaacacggttatgaagactcattataatgacactgaactccttaacttgcaagatgcacttcgtagaaaattaaagaatcagtggttacctcctgagattagtaatctgatcttatggacataccaactttataaaactgaaaacaacgctacttgtattcagtatagatttattccagatgacggtcttattaaaacggaagacgctgacgatgctattgatagattaaagacagaaatgaactatgttatatttaatctagaaactgcagattcgacaagaatacgatctatacttagatcctcattacctagtggatgtattaacactattccacatgcatgtaatagacctacttatagtcaaatgcatcatgaattgtatgccaatcaagcaatgatttggtctaaatcagacggtacagaaagggtattccctatccttcctgaaacaagttctgcttacactgtatatggtatgagaagtaacccagctggtgataatggttttgctttcgctttatcacaaagtttcaaaactggcagctatgaggataacgatatgtttaacacttttaagcattcgaatggtgcaaataattacctagatggtacaaacgaattctttgccgagcctaacaaatttaacgttggttctgtttactggcaagaagacacacttcagaatcactcagttttcaacgagactggttgttctcatctagttgaaattaatgcccaaactggccaagcaattgtcgctaaaacgactatgcctttagggtatcagagagtttatttcaactcttatggtcaaaggtcacttatagcaaaacaagtgttcagagaacttttctcagtaaattagagacagttttacacttccttaaaatattccagcctagaggaagtatgtggtagctaagctacctagg

SEQ ID NO: 196 - DNA, 1245 bp, Unknown
  derived from dsRNAs of unknown virus
ataaatatctcttgaggcctagatgcgtagactgtttcacactgattgcgttacgaagagtcgacctgtgaccatgaagaagcaaactggaagcagcaatttttctgccaggtacgatttgtatcagcttatttgtgtgatactagctacagtaggaggaatgtctcaagtgatggcagtaattctcgccggttacataccaactgactatcgtgagacctgtgagtatgttggacatgcgatcgccattctgtgttttgccattcaacttggattgatgcgctggatgcgaagcgacaaagttgcgatcggcgtggtcatggataagatgtctcactcattgtcagcggtaggtattgtcggggacaaaggtgtaattaacaaacaaggatcaaaattgaacgacggcggttatttaaacttactcagcatggcacataaacattttgatgggatggatcaccaacaacctgagatggaagatactgactcactcctgggagacgagaacgtcgaatcattggtgaagttgaatgataaatttgtcatgatgatgaatggaactggacgaactctttctctgcgtctgatgtctgatttcgtgaaggcagtgtttaccgctgaattcaagaatgacgacgccactcttgtagtgaaagatgacaccgtgttacctatgagtctatttaatcaaccgatgacaggagcagttgttgagaagtacaacccattctacatttatgtcacatggggagtacgtgaggatggaacgtggtatgttgctagaggtacagctattccaatgccgtcatatgttaaagattgggctcttaaacgttcagctgcaggcagaccccacttcgctttcaaagatgctccttggattaatgagactgtgactaccactgttagcactcaaccccaaaagacaccagcagtgatggtaccaagcagtgtctacagtctgtatcccaatattcataaagatgaaccttttgtttcagactctccaccgccatatcctgtagctgcaagtccagtgtaattgacaactagatcatgcgcctactggatcaacgattgtatgattggccttcttgttgctaaattgcgtttacctcactaaatttcatccactagccttaccgagaattataattggactctcacgaacaatatcaggtgtggctcggctacgtggtaggtccctgcatggcgccagacgtgacagttgaggtaaacgat

SEQ ID NO: 197 - DNA, 2010 bp, Unknown
  derived from dsRNAs of unknown virus
gaataatatttatctatatattttagcataatgttgacaagttctagtaaaacagcatccgctttacaagagttggtacacctaacattgaaccctatggggaagcgagctactgagaatgtagtgtcccccggagggtcaggaggtgccatctatgtgttagagggaggagacaccctcaccatggagaataatgtaacacaagctgtcattactttcgatgatattgctactttacgtcataacaagttaggagcagtagtataccagaagaatgcctctgggtccgttcttaaggtctccagagtgggattagctcgtaattccagtgagttcaaagctggcgcagtgatctcttctactctgcaggttatgaataactctgcaaacctggatatttccggtactatctcacaagctatcatctatagtgtaccagatgacatctcttctatcacaaccactgatcttatgcatcttacctctcctgactcccaagtgctaggtattgatacgagaacagattataccatcactaccaatatcacacctgataatggcttgttccgcgcccctctaggtgatggatgcagtgctcaaccctcatccttccacaaattcgctactgctacttcttcagctacccaagggttctctgatacaaccacagaactagcgcaagtggcatctggttccgtagacattggtgacagtgctaccagcatcacaggtatctttgatactcgtgcagctggtgctttgaacccatgtaccctagctacctatcgcgtagagttagaaagtgatttagtgctcatcagcaattccgacgaagtagcagttggtaccaacatcactttctttgccctaggattggatgcagctgggaatgtcattgcccgtaaagacattcaagtgactgtacccgtcactatgaccgcctctgtggacatgtccgtccatatcgaagcgctactagagtcctcagaagtgcccattgctaatttgctgttgtgctctgataccacagatctcttccgtgctagctctgctaatgctgcccgccttactgcaattgaggagactggtaccgtagctggccgtggtatccatgttgcagtactacaagggttaaatgccaacgcagtcattaaccttcaaggaggaactgtaattgatggtgtagttgatcaatccaacgctcagttcgtacagggtaaagctgtagtgcacggaatctcccgtactgctctaagagatgggtttgatgagtggaagcttgtatgtcctaaagcttatacaggatcaggcatgggtgcagcttctgcagtcattgaagagtttttcggtgagcccagtaccggtggtgctgtagaagctcgaagttatggagcgccattccatcgtatggtccgacaagtatctagccttcacgcagctagccccatggaagcccgttccttcttcgacagaatgaagtccgtcgggaaagggatgattcgtagaactcctcaataccaggttgccaaattggctggtggtcagttagaaaaatacactggagctgatgtggacaaatatgatccatttgcatgaagaagccaatttcctacggtgatgcacacctcatcaggctatgaacccgctcggatgttctccttacgattatctgctagttcttcactatcattggaccctaatattcatgatataggtgcccctttggcatcttacctcacggatatcgggatgggtgatgtaagaattactgataacagtcgaggaattcccatccgggggaggtcgtgggaaatggcagcagtaatggcatctcttggacgttatggcagttacactggaaccgtctcctcttatgatggaaaccggattacctttggccctgtacatgacgtggataagaaggatgacttagattctagccttgtctcctatgctatgattagaagtgttaacgtgccctaattttcatttcagatttatattttgctc

SEQ ID NO: 198 - DNA, 1695 bp, Unknown
  derived from dsRNAs of unknown virus
ggggattttcgatttactgaagcatcactggtgatgtctaatgtcagaggtcttttcaatacacagtgtagcttaaaaggtatcactcattcactcactgtagataacaccgaaggtggattccgggcttctattaccttctgcgaccgatacacttgggctgagaacgtcaagaagaaagctgctatcgcacaagcttttggactggctcttgatctgttgaggtgtgagtttggcttatctgagcgtcaaaattgtccccgcttggaggagttagttagtgaattggatttgggatcattaccttcagtcataaataagggtcacctgctcgagctgggagaacgtgagattgttcttttcaaaatcttattccaaagtatagaatcaggtgttttccgcgattactcagaatttcagaaagttataagaagatacgggtataaggcccatcaagatggaagtggtggcattcatatcaggaagattgatggcgcataaggattgggatattaatactgacagtgactcatggaactctgcgatatcagcttttgaagggcttcccgatttcatgccttataaacgtgggttggaggaattgaggaagaatatttgcttttacttctctctatcatctattgacagtagtgaggttggtataaatgagtattttagatgtccttgcggcgctcatcgtgagcttgaggtggtgttgagcccagaattgaaatgttatcacagaatgatcatgatgtgcatctcgagtgtgatcagggaggccataacagtgagcagggttagtgctggtaacgatgaggcgcgttgtgcttactgtaatgagctgatctcaatgagggtgttggtgagcaagaatgttagtgagatcagggatcacattgcaacacaactggatgttgatgatggagtgagattgtgctactgcgataagaataatgtgtgcaagtgttatttagaacagtccttgggattcggaagttgcgtgcccatgatctacgcttctcaaggatatcatgctaggcacagttcatggtgtaataaatgtgagttcccacgattctgtaccaaccccgtttctttgaatgaagagattgcagagagtttgattagcgctgagaacaagggtacgttagatgtgccatttactcatgaagccgacgtcatgcctctaggaatgtgcgttgtcaattctcgactcatatctgactttctagcatactcaagcaagaggaagactatttatttccaagcagggtgtgggtgtctgctagatggcgcatgtaggtgtaatactgatgattttattgttgatagtatgtttgtggacagatgtgtgacaccatcaatggccatgtccatgcgtagcgcattaaaggagcgtgacataacatttatcactgattgtaccatgtgtggcaagacgcagttgtgtcctgagacgtccatgaacacgttcacagcttatgatgaaacttgtgttgacacgagtgacaatatcgtgcatctgcagcctacgaacagggtgattagtgagtatcttggtttgaccaggttatttccataagcctaatgagagacctctagcatgtcctagtggagtcgcccgatgcggctctaccggggggcctctgtggcgctgttaaagcgccccattggtgtgtataatgtacagac

SEQ ID NO: 199 - DNA, 905 bp, Unknown
  derived from dsRNAs of unknown virus
gaatatttttgcataattcacagaaccatgtttacgtttcatcgacagagcgtgaacatgcctggaaggcaggagccggttatgcccaccggccgactgtctatcgaagagaaacttgagcaagtggactcgctaacaatattaatagaaaacgagggatcgatggtgtcacagataaacatcggtaaagatgaaaatggaaagacatcagtattcatgatgaacgttaacgttccatgggaaaacccattacgtggagttcgtatcacgtacaaccgagcttttgaggataaaataaacccgaactcaccagccggatccgaacctatgaatgataactcgctttgtgaaacgttagttaagtacgaagaagaaacgtcgaagttggcgcagcaaaatgttgaaagaaaatcaatgaacgatgatactttcgaggctgcgcttaaggcgctaccgaagattagaactccaacaccaaactcagacattgactgtaattcactctattcagaagaggaattaggtgatttgcagaaattcctccgagtttcatcagttggtaagaagtataacattaaagttaaatctgacggtggattgctggctgatttaaagaacgttctaagctcgtcaaaatcaactaagcggaatatctatgtgattactaaaatagatgatcgagacgaaatttcgcataccatagtattatcaaagacgcgtcctaaaaactttgtgaacgtacgcacgttaccaattggcgtcgatatatggctaacaaaacatgtaccaaagttcaaagttcaatctgtaaacgatattgaatacgcaatgctgcagcatgtgcgtgaagcgttggtaagcttctttggtttctaatcgaatacgaagtatgcaaaatgaacatc

SEQ ID NO: 200 - DNA, 960 bp, Unknown
  derived from dsRNAs of unknown virus
gaagaatcctctgatactattgttgtggcgatggcggtcatggccgaagaactcggcgtgttcgcccagccctgtaccttcatcgttaagatactagaccagccacagccaggttcattcacgtttaaggtggcgtcaaagccttccgcgaaagctccgttctaccgccgtaactgcgtggtagaagagccggtcaatgtcgagctctgtattggcttcgtccccaaaccgattcaggagaaggcgacgaagatcacgaacgctcaggctacggacgcaaactcgatcttcgtcttggcggggttatacctcattacggatggcgagttggaggacaccttcatgaccggggcagagctcgaagagcttcgagacagtgcagcccccatattgatggcggatatgccagaagcggagtccgcgtcggctggcggaagtgatccagtcgaggcgagtaagctcgcaaagcagtgtcctcccagcagagtgggtacggtgcacccctcggccaacgtccaatgcgacgacggaagtcggcaatgcgtttgcggctcggtattcggaacgcaagaggcttatgcaaggcatatggctgatgtgggccactttacggccaccgattacatcgtattcgtgacggataatcctggattgaactgcgtaccgtggccgcctacggcctcaccagctgatggttacgcgtgcgttgtgaagttgcagtcgcatcgaaggctggcggactacatagtctgcgagggggcggtgcttgacgagatcaggcgagctacggcgggcttcgaatcgaagccgttcgtgtgccagtctgactcaataagcagcgcggtcgctgcgtacactaaggtgtgcgcggaggcacacatcgatggtatccgcgagcggaagaagggctaatagtccttgctcgggcgcgcgtggcaccgtgtatggattgtaaagatc

SEQ ID NO: 201 - DNA, 1551 bp, Unknown
  derived from dsRNAs of unknown virus
gaatttaaatcccttcccacgataggaacaatgagcatgctactagacataaatgttaaacctcgtaagcgtaatgggttcagaaacgcaagcgctcccttcatgcttaaatgtctttcaaaggagacgatttctcgtcttagaaagtcggaagttggccagggcgtcgaacctgctactcccactatggcacgaaggcgggatcagttagctaatgacataggtatatcaccagagttaatggaacaggagattgggaagttgttttatgaattaaacaacgaaatccatcccggagtgctaaatgaatctgagatctcaaaatctaaaggagcttttgatttgaggtcagtgatatgtgaaaagctagctgaggatgccagcaaaccagtgcttacagaagatgacagattagaaacaatagcgtaccataccatattgattaggatatatgagaagaccaatccgaccgtaaagtatacggattcatcaaaaataattaagcatggagacggaatgcttgtattcggcggtacacgattacttaactatctatatgtccccggagatgttaggagaatttacgataatgtaaaattcaaactacacaacaaagacgacgctgtaatcttgtcatcatctgtgacgatgtcaagcgatcgcatgacgatggctataaatgtagacgtttccaacgaacatacacacgatctaatctctaaaataaggatgaccaactacatcacctatggcgatagaaatgtagttgcgccgttcattattgaaagtatggggctggatagaggcaccatcgtcatacatctgtttacaaactccattggtgaagctcttacacattggatggatgattgtacgcgcttattcctacgtatgtttgcatcggtggttaacaccctcaaaactcaggagaatggtgaagcttactattctcctggacttggcgggcagttgccaatcgatttcttcagagcgttgagaggcacaatagaagctatcaacgataatggcaacatagagaggataagtatcagtacggtggtgtacgaacttttctcggcatacgcagcttcaactgacggtaccctttcaaaccgtcgtttacgatcagttttcggtggtttccaacaccttgaatcgtttctgaaatccttcattacacttttcggttgctttgatagattcaatagaatcgcgtcatacaataaactcgatgagcgtggtacgatgaagccatatgaagagagaaagagaacgagcgatatggtagctgacatgatgaacaaagaagttgggctgactgaactaactcgcacagtcgtagaatcggcagataaaattctagctcgattgagaactggaggcgaggagttcttaaagttggcagttaacgaagcgaacgttcacattacaaatatgagtaactacatgcgttgaaatggctgtttattgtttcgcggataacgaaatggcttgacacacctctacattatacctatagtggggccggccgcggcaaaggatagtaacatc

SEQ ID NO: 202 - DNA, 2449 bp, Unknown
  derived from dsRNAs of unknown virus
ataaattacagtgacagttcatggtcgcccgagagatgtctgatcgttcgcgcattcatgagaaaagataccaatcatttcgcaaattagaagactttgtccaagcacagcacgacaagaacgtgacttcaaattctaaggtagactggtctctgcctttggtttgtgacacttctggagctggcgagtcatcttgtaggattgagcgaacacaagaaatattgaagaccgatgaacgtgctgtggacaggttgtttactcatgtcacatgcaaacggacaaatcctgttacacctcaattcttggacaaagacataaaacaggtatacactaacaggtatcagatactaagttccgttcatgttgcagtggctaaggaagagattttgtcactcgtatctgaaaagattggcctaccatctagtgtagtattgcgagtggacagaaccaacatcgtcatcactggacatgttactgaaaagtggtatcagatcgagtgcgatgcatctatccctttgctctcattatatgtgcatgctatccctcccttaaagaagttaaacaataatcactacatttcccattcgccagctcacttatcacttgaagacagtgctcaaacacagaagatcacctttgctaatggaactgtttttgctagaagagtcctgagacatacgtacaccgtggggactggaaccttagaacccttttggcattatactttaccactgacagatggaacctgcctgtactaccacgtcttcccgcctgtattaatgcttaatcatcacctaagtcataaacatttcaagctgtctgtggatatgtttattcaattgcttgtacgtaggggaggcactttacattgtgatatcagaagaaggaacatagcagtcatagatcataggttggtattcatagatgatcataggcaagatggtggagaatacctggcaaccaatccctactattatgactgtggagacgctgaagatctgatcctacctaccactttctatcaggacttattggcagcatttagagtcatggcttctatctcaggatgcgtctacccttggaatgtcgaccggaatagcgatgctgtcacactgttatttgacaagaatatgaaactcagcggtgacaaatactatataaccatgacttatggggacatttaccaactgagtgtgcttatgcgcaagcatatgcgaagactagccagacccagtattgatatagaatccatgatcgtcaaacacgtctctacacctactccatcacaattggttgctttccggtgccagcaagagaacagcggcattagcgatcatgttgacggttgaatatgtctggctcactttacttcttccacttctttcgaacataaactttccctctccttcccgaatgtcgatatatcgataggatgcgatctcctgttaaagaaacatgcatgtggctcgacaccatttgcagcgctgttgtaagtcggtgacatcattcgtaacctggtatctcacagggtaggcactatggctagaacccatagcggtagttagcgcagtgactgtccggtggcgtgcgtttgtgagcaaagtagcgtcgaataactcctcacaatgttcagtacaatgcccttcggtcacccctgctgccgtagaaggatacgctccagaaacgctatctcgaatgataaaccgcaacaatataccatggaagatgactttttagaatactttaataaacccctcttagactgtacctatactgtagaccccaaccatggcgcaaagactcagaagcagatacgtaaagaacaggagaatgtgcggatgttgatgtttcagcggggaattccacagaatccgaatgaatattgcaccatggctactgattctgactaccaactgtatactgttcattcacttggtgcccgagccgcaatatgcagtatccagaatctactccattaccctcttaatgcaagcgcttctcccagactcagaggattggtcacttatctacgaactcttgacctaagcaatcaaagtaacgtgatcggcattctacagaatttgaagtgtcatcctctgttcaatgaatacatcagtccgagctgggataagatcaaagccttcttgatgatgatgagtgcaacaggaatgccacagtcagtgtcagatgattacggcgattaccttacggatgaaaagataaccaccgtaactttcaagggctttacagtcgttcacgcagtctcatcgtctagatatggatcaagtgagatggaaggggaattctacacgtgtagcgccaccgctgccgacatgttcagacatctcctcgctaactaccacttctcagaagaagcgtgaggaatgcaggacgccacactctcggtttgaactgaattactgctggcgcaggcactgagatcaacgat

SEQ ID NO: 203 - DNA, 4306 bp, Unknown
  derived from dsRNAs of unknown virus
ataaattttagtacactggatgcgcataatggctgaacggttaaaagaattacagagagaaattgacagaagaaaagaaaaacacaagataccgtccaaggatgataagatttaccctcccgtcgcgcccgtcgatcgtgaaacaccagctcctgccagagtgaatccttttctagattcaacatcatttgcttcactgcataactcattgtatggtaagcaggtcgccagcgtggacgatgagcttgctcgagtatgtaaactggagtatgagttgcaacagcggatctctgaagaacaagtcaatgcattgaaacagttcttaactattagaacaggagtgccacaagaaatacaatatgtagacagagactggatgaaggctaacaaacacgtttcatctttcttaggagatgttaaattgatgtttggagatacagcagggaagtttcgatctacaagtaagtcagtggactccatacagagcatcacctccgacgtacaagttacgcaaaagaaacagtctcgttcagaaattcgcaattcctaccgggtgcaaaagagtaacaaagtcgaacagcccttgcaacccaacattctgtatgtgtatatgtataaaggacttgctcgagtagtgttgcgttttgtccctaaggtagtaactgatgtaagtagtagtgataagtctagcaactctaaggatagggcatttacgtatgatgatttgagtccggcatggaaatacgtactgactgaagctaagaaagcctttcctgataatgattacaaggattgtattcgacccatgacatggacacaatggttggtagagaatttgaatgatgtaaaagtgttgacgcagtacgcccacaagcttgactatgtcaccctaatgcaggatttcaatttgtatgtatcaaagggtgccagtcgagttcggaacatggacatgtcatctttacccacttcaataaatgtgatcgaccattttgagttgtttggtgatgagagcatgcgcgatttcattcgatcgggtgaatggtacagtctgctgagcgaagtcgaacatgaaggtgcgccagtcaatgagagtgaaaaagtgtttgcaaacccagatacttatgtgttgaatctcaagaaatacttccttaggaggtttcaacaggaggttgcatctactggaatgacaccactcactgatgaattgctgaacatcatgtttattcattgggatatcatcgtctctgctgaacctaaacttcaaatcataaaggatgacttgcttaagtactattccaagtatggtgtagatgctacattcgattacaatatgaagcgcggcgagatgactgtagtgactcgtggacatttgcttgctcataaggttctcgaatgtgcactgagaacggttgagacagtctacacttatgatctgcaggatgagaccttcaaagatatactgattgatcttggacggttaataatgcgagatccgatatatggtaccactacagtgagagatgcaaccacagttatgaaacaattgatgtacactaaagggaagcagttcagaaggataatgtttaggaaatttgactacacgaacttcaacgaacccttggtccttagaggcgaagagatgacgagtgaaccacctactctgttagctactacacattaccaagagatggataataagaggatagactccttgattaaggccaacgatcacgcagggaagatcttgcctttgtctagcatatatcgttgtagatataccgattccttagatcttgtaggagatgctaacagatacttctctgcactcaccactctggaggcgattgctggatttgctagctcggatctgctgtctggcttcatagatagtaacgaatctattaaattcactggcactgaacatctgcgcaagctactatatcatagtgtgagagaacagattatgacattgaacacctcgacagtaccgagaccatctttgctcaaaattttgttatcatcagcgaaagatacggcttctgcagtggttcgtccaacaacttttaggatacgtaagcacacaccggagtacgatggtttgacattgaatatagtggagtccactgtagaaatgtcgacacgccaaaagaagccaaatctaatgagagcagctgagatcttgcgttctacagtcactacagatgaacagatggtgatatcaggaggtacgcgtgctgttcaaggtgggaaaggagctagagctgtatatccaacaaagcaaccatatcacatcggaggatccttactgttccacaaagtagaaactgtcgtcaatgcaaataagaagtatcgtggagtatctaacaagtatgggcaaggaatcagtaatgctataccgcacattggtgttcctgagatcatcgcagtttcatctgatgggttagctatgtgtttagccctagatgtgtctgcatttgatgttgctcaaaaatacactgagactgccattgaactaggtatgagagatggattcatagattcagagccttctttggtttcaggagaaacagtgctagaacgaatgaatccggctgacttggcaaacaacttacttacaaacactccacctaaatacaaatatcaaactgcactaggtgatatcattatcttgcagcatggtaacagatctggtgttccttggactggtactcagaatgatttagttaatgttagtaaccaccagatggcttatgatgaatataagaaacgcatcgctgacttgcagagggaaggaaagatctccatgaatgtgaatgataaacatcatattgttcgcgtttttggggacgattccacattcatcatgacctatgaggagccaccaaccgcggaagaagtccatttaatgtgtgccacttttgtagagagttaccaagatacagcgggtactttgggatttgcaatcaatgctaggaagggaatgataggcagatacggtagtgaatatctgaagaactcagcgatatacggcaatattaagtctgttaatcaggtcaaatttcgtggatctgagaagtctgctagttatcacgccggtgtttcagaaagagtgtccatgatcagagatatcacagacttgactattacacgtggttgtgatgagactcgaaaatggaagtacaatctcatgatgttgccaattgatttgaccacgagggctggagcatttagaatgtataacttatgttcaatcatgaccggtgttggtaagatgttcttaggtggtacccttaacaacaaattgattgcctcgtatcatggatcggcctatggttggaacttcgatgataacctcatcaagacggccaactcgattggtgccattgctgactcctcttatgatgccatctccactaagattacaaatttggcagactttaaggactctcaaaggaggataactcaggatatcatcactactggaagattgcctcaacatttgaatagatatggcaagtctaacatcctaagacacatattggcatctgccgccatgggaccactatctcagattgaaaagaatgtaaatgcatataatgttgccacaggaattctcggtggtacactagaaacaccaacagtccttgagaggttaaagataggatttaagtatgtcgttatgtcagatctgaaccaggatgactactcaccttattcgtgtcaaagcttgcagtacagaagaatgttggttcattggggtctgaacgactctcgaatcacatcttttgatccgaagagtaagttacaacatctcctagcaaagaatgctcaaatccttcctatacactttgacatcgagtttgtctacagactgtacctacaagcaggaacgatggcctttctccaggtcatgtcctactatcagctgccagacacactgacccatgaaatgctagctgctgtagtgtcactggaattgcaacttggaaatgataagtatgctgtagatatgggagtatactctagtcaagctgggcagatccgtatcaatgacaacctgatggacagtataatacagcatcgtcgtggtcctgcactaccaataattgatcgtacactcaaccgtcttctactccacacatacatgcttatgtttggactgatgggaaagtcgatcgatagtaccaaagtagaccctacactcagttggagagccatactagaatctaatgatcagcgtgtatcgcaactctctgaacttctcactgccgtgtagctgtcttgcgttgtactaacgatcaacgat

SEQ ID NO: 204 - DNA, 1714 bp, Unknown
  derived from dsRNAs of unknown virus
gaatattattacacatacaggaattgtaaacataggtataatataaaaattatgcgtggtaggaatttgactcgaacatcgttccaaggtggaagtagaggaggttcagcgcctgcgtcatcgtcgaatccaaacccttcctcaggaagcgcttcttcagggcctattaggggtagaaatttaacgcgacatggatacaccagaggggaaagaggcctcgtactcgacaatccctctgagggtgtacctgacgactctcctgatgctgtgattgatagccgtcccgaagatgtacctagtgagccaatcgttgaaactcgtcctgaagttgtatttagtgagccaatcattaagagaccaattgatgttagaccaccaaaattgtcctacgacacagggaagagcgttctcatttcaacggaaaatggacgcccagttatagtaatgcctgacggattcgaaaacttaccagatgactatgagatagccattgttgagcgcgatggtctcggtttcaataacgaagttggtacagctcaagtggattcgtctacacccatcgaagggcctgatgagtcggagagagaaaaaccattcttggagggactagctgaaacctttgttgaaacagtgctacccggtgtaaacgctgacattaaaggaattgatgagactatcgtgcagacagtctttcctaagtccgggatgaaagactcaaatgacttgggtatggggatggttaaggctggagtgcttttgtcacttccaggtatgccgacaaaaggaattggaattccattacaaattgctggcgacgttatgttggacctgaacaagggagattataccggagcgattgcaaacttaaaccctattattgcccttgggacggatgaacaatctggtatgattgataggaaggtgaaacttggcggcatgattggtagtttgatggtcggagatttcgacgcagcaggcaagagcgcagccacacatccaactgacgtgccggaacggaaaccatccgaccatattgatgcaatctggggtaacgtagcaggcgcgcttgaggggcccctcaacgaatcatcggatactatagtaaaaggtatactgaatcccgagtcacttggctccatatttaaagcggcgtcaaaatttgatgacatgtcttcttatgtcaggtctcttccgggtataagggtgctggaaagtgatagatactataccgtattattttatcccagaaagggaataacctacgttgaatggaaaccaactgaggacataatgaatttattttcacgatcacgtttacgctcaacagttagagagtggagtgaagacttcttagctgccgctgggcataaagtaccagcgtggacgaggcgcgtgaattatataaaggacaaatacggaatggaaagtgatactgtaaagcattatggatattctagaggtggtggactatctactcatttaggcggaacaggatacggtacaggatatttttcttcttacttacctcgtaaggaatcgaaaagcaagtttagtggagacctattacatgacatgatcattaatccactttcttacgctttattgatcagaaagaggattgggatatgatcactaggattaacgtttattattacataattgtttaacatgctattctagctagcgtgaactgttttgtgtgatatgaaacatc

SEQ ID NO: 205 - DNA, 6909 bp, Unknown
  derived from dsRNAs of unknown virus
gtatttaaagggcgggattgtttcctaaactttaaatgcactgagctgtagggctaagtttagttgttgcgttcggaacggctggctaaacctaatactatagcttagcgtatctgtcggtgggtagtgtccactggtagtaaagggggtatgggctattctgcctggtgacctatgcttctgcgcttgggcctaaaaagccaagggtgtacacatgtgtgctaactctacttcaccggcagcactccactgggatgttcccagcaggcgcgtgctgtgctatgtaagacggtgttggtgagtatcgactctgctgcacgtacccgcgtgcctaaaagtagagattatgtttgtccgagggggatgcgctgcatcccgctggctgaataaattaaagccggcgactcgattttgtgttgtggtctaaccacttggtgagcacagaagaagagttctcagtgaacgaacccattttgggagagttcaagccaggcgcccacgtagggttaccttggtgtattacacggctgtcggacccagattggtgcccttgcttctaataaccgcacatcattattatgctgcttatgtgtggggtgtgagaaggcggactgggttgtaaggtttaacctgcaaatggctctctaggtagggggagcacagggttggtctttccgaggtaaccgaacccacaatgttgggacgggtgattcgcgctgtcgcacatgtttgtgtcgcagctcagagactgtacgccgtggacccgatgggggttaacttttgttaagttagttcctgggtttaagaaacagtccagaccgctactgttgtagtatttgacctgtccgtaccctactgcgcgtaactagattttagggtttataactccactcaaatattagttaccatgagcctcaagttttcatctgatgctgtctatgccgctcttagcggtgagcccatctgccgtctaaaaggtagtggggattcggagggtgctgacgatgctcctgaaggagcgccagctgtgtctgacattgtcggcactctctttaaccgttcacctaatctggatgttaatgtccagatcagtgcggtcggtggtgaccttgattcaagggtccactttgttacttatctctctcctgctgctgcggcagggagtgttgataacatggagtctgtcatgcacgtttgtcatgatatgatcaatgaccctagtaggatctactccaacaacaatgtcatgccatctcatgcagattttgatgctgctaacatttctcgtgcggtccgtactgtttttcccgcgatgaacgtagccgaccagaatggtatggctcaggggttggctgctttcggcgacttttcgtctaagtacactggtttgtggatgcggttgatctcgttgagccttgcgcttgatgctggccttaaccctattgctgctttaggtaacatgacgtctgcggggcagcaagttgctgggtttgttggtgctgcaggtgctccagctatgttagctgcgttgaatgtatcggctcagggtggtaccggcattactttcttgcctgttgatgctgctccgacgctattcaatgacgcagcgcgtagggcatttgctgctgtgagtttggttaattgtggtgttgtaattggcccaactcgacgttcgttggtatcattgtttgacagcccccacaatatttacttttatggtagtgctaaccgtatgaacaaccagccgtttaatgctggtgcattggcagctgctgattgttacgctgctatgcggtttctcatgagtacaaccggtgatgtggagggtctaaacgatgcgctaggcttgctggccaggcgtgttaggtttatgggacccagaatcactaatcttgctgctcctattgatgagaagtttcataatcttagtcctcaggtgatgcagtggttcaacatcttcttctgtgcctttgctcgcgacaaggatggagaagctaatcgtgatgcggagcttcaggctgctctcaatgctaacgctgcgggtggctatctgcgtgctcgtgaccgtgatgcgacgttggcacgttggggtgctgagcaccaggggctccgtgcacttggtgaaaccatgtatctttgtggctcagtgaataggtttttgttgtctttaacaacttctgaagttacagctgtgtggaaccaaatagctggttggaacttgcgtggtgctaatgaagcagcacctggtgattggatcgttcaggaagacatcagtgctggcataactccgggggatgttgtcctgccggctgaccttactgctcctagttggggtacgattcaattggatcagtctgtcagcgctgatggttttacgattgcggcccaggtgcccacctgtgctggtgtagcacaattgaagagatttatggaaggtacagccaatgcttcattggctgcaaattctaaaactaagacgccaatgactgcattcgcaggtatggctctcagacgtcgcatttacttgatggctattactattaggtgctgctctgacgttgtgtttgattcagttgatagttgtgcagctaaggatgagtatgttgaaggcgctgctaatacggggaatgcggttgtggatgagatgttggattatgagacttccctgggtgagaatcaagtcatcagttcggatgagttgtattctttggtgctcgttgagtgcgggtattacggggtgctaactaagactagcgtagatgacacgctcatgttccactatagttatgatgacttggggttttcgcgtaactgtgtacgctgttgtttccacccagctatagctaaacagtttcttggtagtgattgtggcaggtccggtggtgattacaactacaacgatcagttgtgtttggatattgctgggcagttccaagaggtgtggtctaatcataagttggagaatatgcgttctagtgaggttgcggcattgattcagttcatagctgccactaagggccgtagtactacctttgctacttgggtgaatatacgagtcaatgaattcgggcgtgatgaacagtgtactagtggttttatggccaacgatgtgtgtaggcccactgaaaataggattgatctctcggttatgacgccttcactctggtggtaccgacccatttaccctggccagttgaggcttttgtctgttggtagccaactcagatcaggatataacatagttaatggtgtgcgtgtggagtccgaccctaatactgcttctaatgcgctcaaccagttgtacaatggtaatgccattgtgcacactggcccagcacgaggatctggcaggacgcgttggcttatgcgtagcaatgtcctgcctgctcccgcagtgattgcgccggcgcccaatggtattggtagggatgttgctgttgcgttcactcatgagctcgtaggctctattaacaggttaccagcggtatctaaggtggttgttagcattaagccttactttggtgaactcaaacctctcaaagttacagatgttggtgttacagccgatctaattaagaggaggatttttaacgatgcctttggtatggttaagttgggtctgggtgtccgtaaattactcggctttgttggtgaggcaccgactaagagtgttggtccatcggatttttaatcaggggtgctggcggcaagctcgatgcaatgggtagggaaattgtctcgctcccaatgtttattcgagtttcggacggtgcccgggttggttattcatcgtggatacaccacccccgggaagtgcacattactagtagtatgtataattatttgttagaagcgtatggcgatggagttattgattactcctgcatgcgtgattggtatgagctgtgttttagtgggatcatgcctgattggatgtaccgcgatggggttaagatcaggcacaggtctgtttgggcatcattgcgtcgtaagcttgcgagtagacccaagtataccacatttgagaatggtaaatgtaaagtagtgtataatattgatgttaaaggcggagagagatttaagacgatgattaaggagcagagaatgcgtgataatataatgagtatgtctgagtcggaagtaaagcggaagctacgctcaatacttgcagtagatggtactgtcactatgtccagtaccagtaggcggtttctgcgtgtgttactaccttcgtgcacaactgaattagctacacgctgtaagattacacctgatttggcattagcatgttggcatgcgtcgcggactcgtggtaagagccactgcagtgtggtgactctgtggaaattgctcacggcatggggtattggcggtcaaatgttttctaatttggtgatggctagtttagttaatttagataactgtcacgtggtagaatgtttggtagcacagaattggcataggtgtggtattgagtattataccacaatcactaaggaagttagtgaggtagccaggcggtcaggggttggcgactgccctgcactgcacttggataggactgtttcgtaccacagcttaatgtacctacagaatcttgctgggcggtttggttataaggagttgtctagcactgacgacattgagaagagaacatatgaaggtaggtcccagcgcacctactcgggtggtgagtggctacgtagtaggtttgatgaaattgctgaggatggcatgcatgacgtagctgtggcgtatgcgcgtggcgtgagtggtcgcagagattggtctgctgaggacttcattgctaacctcacattaataggtacttctggtagtgcacctactaaagaaatgagtgatgttaccatgttagacggtaccaccgagcgaatgggtggtacgaagaccgcgtggcttaatgacaagttaacagttcagtacttgaggcaattgtttacagccaaaccttcaatccgtggtactggtgctgacaaatatgaatgtggcaaacagcggttactgttaccagggcctattcagcattggctcctagaatctattgcactattgggtggtgagagtcgagtctatagagagaatccacacatgacgttggaggtgcgcaatatggaagaattggcactgctaactactagattgggctttattgctcgaggcggtaagggcattgctagtgacttcgctgatcacaatatattacataagttccgacgcatgaaagatcaatggcttaggatggcggaagttcttgatcctggcgtttccgggcttatagataaagcttggggtcgtggtgattataagcagttcgcagcagcggcatgcaggtgggcggcggcagccctcgatgatgtggcggcgcgcggtaagagtgttgggtctatacctggtggagaccgggatggatacgtgcggctagtaagagggctttggtctggttggcgctcgaccactttcatcaacactaccttcaacgaacactaccagcgcaccaccatagaatcatttaaacgtatctatggcagggaacccctaacagaataccacatattaggcgatgatatggccgggggagttagagatgaatggtcaggcttgcggtttttagaaattattgatttcagtgggttagacgctcaagctatgaagcagatgttgtcaaacaatcgtcttgagtatctaagacttatgtatgaggatggagcttctgtgtggggcaatgtcaatagagctgtttcaggcctggtatcaggggatggccagacaagtcctgttcgggctggattggatacggctcgagctattaacgaaagcatacacactgttatccggaggagtggatgtagggacagtgagtcatggcggtacacgctggtacgttactgggcgacggtagaggtaggcgctaaagggaacaaacggaaggttgcgccatcacagtcactacttgaagcttcatcagcacacggtggtatgggttgtggtaggttgggtgcagctcctaaagagctcatcggacatgtggagatggcaccatcgacaatggatttgcgctggctaggacgacagctgatacgaaacggatctaagacagcagtgtcttggatgtctcagagattgtggggtaaagggctgaaaattaggaatactgacgtagttgagatagaccatgcaatctcattagctagtgggggtttgcccaataaagtcgctgcagctatacggcacgagcagtgggatagattagccgattggtatgatgctaaccggtcaatagctgctagtgatgtttgtatggatgaggcgttatatgagcgtgctgcctcgagggtgcgcactatgaatccaaaatcactaccgcgtagcgtctggaatcctatagatgtgttgtctgaagcggtggcgatttcggctgggccgcttgccccagctggggttggtgttaatgattttgtaacaacaaagggcaagcgtatgaaaccaattgcggctatagaagcgattggtgtgcctcaagcagtgcggcggttggcgcactcagtgcggctgctcggggcggagcgtgtccaacgcgtcctccgaggcgattgtaaattatcttctccctcatcagggatggtacctgttactcatagagtgattgtggaccattgcctggtggcggaacttgacgataatagagctgtcattcgtaatatggatgatgaagaattacaacgatttgtgacgtcatatagttatgctgtggaacaagcggtagttggcaacaactactggcggccacaacttaactactaggtgttgcgggggagttgtttaatatatgtacaattatctgtacaggggaggttacagcactccactgggttatacagagaaatttgc

SEQ ID NO: 206 - DNA, 1501 bp, Unknown
  derived from dsRNAs of unknown virus
gcaatgaccaccgcgctgattggacgtaaggcatatcttgagactgatgctgatttcatcaaacgatttaacggagtagacgacatctatggaggcaatgtcaaatatgacaaggcatttgagcatctgacttcagatcctagccttcccgctgttcagaagaaagcagtcgcatgcttaatcctgtacctcaaaccgaagctctacttcttcaatggtacctcaaaaactaagggcaatggagttggtgtagagagagagatcactaaatacttgccgcaacacgacgagattcctgttggtgatgatactgtggaaaacgagaagattatagctgctcgcaacaaactcccagaatatgctcgcaaggtcaactttgttggtgtgcgcataattgctctgatgactcttcaagcctgctctgaaggcgagaatgtatctgggttcatttgcatctcgaaggcacatgcgaagtggattgctcacaatcatagcatcaatgatgcactgaaacacttcgattctctttatgcaaaggagaatgacgagaccaaaagtattaagtttggtcacttcaagtcattcatggctgagaagaactactgggaggactacactcctcgcattgtggccatattctcaagaattcatgagtgacagcctctgtttggactccaacagtcttcatgttagattgcttgcgaacagcatttatgctttcattcaagcaaactacttccatctccatccaaagatcgttgacctttctgaaaaggtggtagcatttgagggagtatatgggagatatctggtttgttgctgtaggagacaccgctgacactacaactgcattttcaccttccaccagcgctttgagtcttttgcctcccgggatttgataacctggtgtgatcttcctaaataccttgtaggagtccaaacatccaaaatatgcaccgtcattgactatttcgggttttgcataatcgatccgagtttcaaactcttcgttgaggaaagctcttaatgcttttgagaattcctcgtcttgagtcaggcttatttggttcatttgaatctgattcgctattctcggcattcgactcgtctctttgtaaggaacgcagtattcttttgagttctgcaagtctttctccaaaatccttatgctggaattcataatatattcccaaactaaggtatttcttacagagatcggagggatggccaaccgccttgaccagctcgagttgatcagacactgaacgtaagtattcttcagctatttcgtcaatttcaggacgaatttctgtacgataactttggatgtcagcgtaaatggagatcagaacgaagtgatagcaaactactaatgtagctctttcagcttcagatatatctgatttcaagtctatttctttgtctgctagttctttgtaaagttctagttttgtaatgaaagtcaattctgagcctgtgtccgaagcgcgtaggtcattcc

SEQ ID NO: 207 - DNA, 1581 bp, Unknown
  derived from dsRNAs of unknown virus
gaatattatcgtacttactggaattgtaaatgtgaaaatcgtcatgaactctacacgggggaggaatctcgtccgacacagaatcagtgatgggaggaggcgtgctccacgtgcgcgaacttcgttcctaaagccgccgccctcagtcaaaccgcctagtgctggtgtgaaaccagagcctgaacccgaggccgaggaatcgaagccaccaatggaagaagaaatcgaagaagaagtcgaactggtggaccctcatcccaccgtggaagaagccgccgagcttaccattgtgtcgcaacctgtggagccaactaggatcattgacatcaggaagcccagggaattactggaccttcctctgcttatatcgaaggaggatttggccgacatcacaagtcgtgactccatttcaatggatgacggatatgaggtacttcttattgaatcacagccaatgcaaccggaaccagcacctattccacctgaaaatgcaggtggggaaggggagacaacgctactaccaaaggaatgggatgaagctgtagccacgacgttactacctggagccggagtgggaagcacaaatgagataggagatgtcctaataagcgccggaggtttagttgcggccccgggtgtaccaaaaccgaatgctgtagtgggtatcggtatggccaagactggggacataattaaatcgctaaacaaaggcgactatacgggagcgatttacgacgcctcacccatagcggctctacaaatggatgagcaatcgggagcaatagatcgtatggttaaaacctttggtctcgttggttcactagtgtctggtgacttaggtggagctaaagatagtttgctgacgccagcgccggaagcagaagaacgaaaaccatctgaacatatcgccgtgattgggaaggaggttgctgattacggtgaggctttgggctcaggtttgaccactgggttgtcaaatttagataaagttggtgaagggtttaaggtattaggagggattttcaacgcggcctcaaagttcgacgatatgactgaatatgtaacctcgttacccgggatacgaaaagtagaagaagatagatactacacggtttacttctatccgaggaaaggcatcacttatattgagtggaagccgacggaggacgttcggaatatcttatcaagatcaaaattcaaaaatgtacttcgtgagtggactgaagactttgtggcggcggctggtgcaaaagtgccggcgtggtcacgccgagtgaaatatatcaatgctaagtatgggccagagagcgatacggtgaagcactatggctactctagaggcggaggtatcgctacacacctaggtgggacgggatatggcacgggatatttttcctcatatgcgccatcagcaacctcaaaaagtaagttaagtggcgatgttatgcacgacctaatcataaacccactgtcatacatgctgctattacgaaaacgaatgcagctgacataaaatgacgtctcttgcagttaactcgctattctagctagcgtgccctgtgtgataccgtatgaaacatc

SEQ ID NO: 208 - DNA, 2490 bp, Unknown
  derived from dsRNAs of unknown virus
gaattttgagtgcccaaatttaaacatttaaaatagcgtgatttgacattcatcgggggacaaatactagaagctccagcttcgagttagtccctcgggatgcaatccactactacaaatgttatcaccacaaatgtaccaagcgccctggtactgaggccactctccccagctgtgagaatacgtaatgcctttatgcgcatgggattgatcttcgaattcgtggattttaatgtgtccgatgcgctatcggctgcgtatactccagctgacatgatgtcaccactttctgataggcatcgtagattgttatatgatctagttacatctcgtgagcttttcaacgatgtacctgatctaggaacaagggtaggaacgttcactattaaccctaacagcggcattgtttcgaaccgattgctttcggaatcatcaagacgaactttgcttcaagcggaaacaatctgggataatatgatgaatgacatccgaagcaacgaatatctatcagagcaaagtgatatgagtgaagggcgtttcacttatcgcacaactgcgggggcaagattcccgcgaatcattgaaaggtcggaattagatctgaaagcgagggaagatactagcaaggatgcaactatccacacggacttctcaacttggaagggcgggctgaggttccagtcgactgagcttgatgattctgcatcttactcgacaagtgcgccagaatcttctgacgtttacgcaagtaagagagtaaacatcgtgttcccaactaagaaaggagagctgccaaagcttaacgttgcgcaccatgcgaggagacgccttatccagtacggagtagactcaagttgtattacccttagatcaactacggtacccggttttatttcaagcgggagaaagatacccaatagagcggaggaagttggtgcggctcgcaccggcagcgctggtacgtacaaactaactgtggaacttgacgatgcagatgtatcattatcttcaaataatgtcagcacatgcaaggtagtcataagcgtacatgtcagaccaaagcttggaagagcagacgtatcattaaccgacttctttgaatctggcaacgatactctggagatcgtgcagacaccttcagcctttgtgattacgataattcccaaagtgctggctagtggccaaccactcttgcgagcaaccggtatgcctgttataccaaaatatgttgatattgacgatgtgtctccatccgtagccatcattaaaacgaaggacccaattggtgccgatgccgatgtcgtagctcaaacgatgaacgaagcgttaaggagcacggatcaatggttgaacgtgaagcacgacgaggtgcgcagcttctgcgacacttccagtcatttaagggaaatgtatgaaaagcagaagttctcatatgtgaccaaaaatggcgttgaatttgctgatgtcgagctccttcaacgcaagtacccagcattgttcaatggattgcatgatattggtatttccatgctacactacctctgcgccaaagacaacgtcatggatatcatctcacatgagactatattgaagcagtggcccgtactatttgataacataagtggaccaagcattgttcattccgaggaaattcgatcacctaacttacgaggttacggagcgaaaccagtaacgtcatcccttctcctagtgaggcttgtactctcacgaattttgaatgttggaataggcgaatcggatcataatcctcttaacgtgaatagcgtcctgctatcacatcacttagtgaaccagaaaagagccgaagccatgctcataccccttagtgtattaaaagataacctattggtttactcgctaagcggacaggtctctaactacctgaaagacgtgagcaaggagaatctcagggacacagctcttggcaaaatgaaagctaagagcttcgttcagattgatggaaaacgcatgccaaaaattgacgaactgtcgataaacgcgctattttctgtacgagcgccagtgcttcgagtcactaggcagagccctgctttaagcgagctctggttcgtggcgccatctggtctagaatttgacgtaagtccaattgcgatggaaatatgtcataaattgtctaaggaaatgctactctcaccacgtgatagagccgtgattgcatggcatccactcttcactatactggtgtctcgtactatagcgaagaaaggtggtgaggataggtatgatgtcgtattactaccggcaaagagaaaatcatcaattgccaaatcgtaccataacacgactgacgtacttagagcggtggattatgatagtgatattctgtcacattatgcaaggttgcgagaaggtgcaggttacatagccgcccttaaaacgcatgttgcttacatgtaacgcctatattctccatttttaaaactgggatccacgcactcatgaaacatc

SEQ ID NO: 209 - DNA, 2255 bp, Unknown
  derived from dsRNAs of unknown virus
gaatattgagtaccaaaccaattacaccaaacactggaaaagaataaatcgactatgtcattggaagaaggacagcacacaaagactgaagaagtgagaggtttaagtgagcgggagttaagatggagaatatttagctttgcatacgatacattgtcgtcaaccgaccgtgaagctgagataatacaagccttaaatgatcgtgttgcagcaggagatgtttcaaaacgtcttggagcaatgcgtttaattaatttccttaaagatccaaataacacagataattcattggcacaacgcatgcaagctataaacgcagagttgagattaggcgaagtaacattcacacccctaatacgtgtatccggatcaaccattaatggaattgtgaatacggggcgtaattatagggagaggctaagtgaagtggatcataatattgacgttgtgtatgatactgcaagaagactaagatcaggcatcagccaaaatggcgtgttgagctatactagacataatggagcattgattccacaagtagttgcaacagatgaactgggaggtggcgaaagagcaatattttaccatgagtacagttcaggtagctatggcgtagatcttcccgttgtggatgagatagaagtggggaattataaggaagcgaaatatggtatagaagtagcgaatgagcttaataacaggttaattaaagtaattgacgtttttgatggagcagaaagccgttcaagccacgccgttgagcgcttatcagattacggagttagttgtgatattgaagcagctttagttacacttgttagtcaaggagagatattttgtaatatacaaggaggtagagttatacttaacgctagagacgaaagattagaagatgggaagatgtgcccgtctggcaaatttaagtgtatagtgaagcatacggcgaagctaaatttagtgacgcgtgaaggagagagctatgaatgtgacagcagtttagtaatggcgatcgtgatacataatcagccaactaatactgatgaagtcatggaagccacgttgttgaacttactaaccataatgccaacgacacttcctgaaccgactttcgcagtcactggattcccagtaatgccgttaaacgtattactgcctgacttttcaaagcccgtaatgttaataccaggcaaagatgctatgccagaaacagctaagttcgctgaagatgatctaaacaaagagttacgagaaacctttcaatggtccaatttaaagataaaaggaattgaggatttaataagagacctgaacccatacgctgtaacgaaaggcggagtagaattcgaacatgtatatatgctaaaagaatcgtcccgtgagacatatgacgccgctttagaaagcggaatttcagcgatatcgggaggagatgtaaataaaatgtataaaatgcttaaagaaaatataggaccatccatagccgctaaacaaatcattcagtcacccaccttttcaggatcgaatgtgaagcagttcaccgtagatgatttaatagttagatggacgctatccagaatgttgttgttgacgagaaagcaaaataataaaaagattgaattgacatatagcctatcagagaaacgtgcacaaatgttcgggttaccaccgtcagtcacgtattcaggcattatgttctattctgtggatgaactactacgtgagagtataggcaggaggttcagatcagttataaagaagttgccgaataatttcagagctctattatctgaacgaaaactgccgaataatatctcaggtgctaactacttatttacagtagaagctccattagtggaaccaaggaccgatgaaccatgcataattaattacgatgggaaaatagcgtctgtacgccatgtggttgctgaggctatccagaaaatgcgtaataacgaaattaaccgcatggcggtagcatggcatccatcattcatgatcacaatcttgctagatactacgacatcgcacgtactgctggactcgtcagctcgtggctcaagtatcgcacctacttaccactctccgaaaagaatgaagaatttatactcgggtggagagatagggtatggggactatgcatttaagcaattaggacgaaagcttggctacattggtgcacatctaaacgcaccaaaatgaaacatgtcattagtgaagtgtaattgatgttttggatccgcgactcatgtaacatc

SEQ ID NO: 210 - DNA, 2772 bp, Unknown
  derived from dsRNAs of unknown virus
gggtttttttgccgtgtcaaaactgacacatttattttaaaagagtttctctttttcttcttcgtgttcttttttcagcaattataacccaataattagaggtattccatctctaagtggagtggcattagattaaaatctgccctaatgcctatttaattatcaactaataagattgttatgcaatttccatttgaacatactatcatttcaagccagagaaaaaaccaatttggaacacaatcattcaaatcttcggttcatcaaattcctagtgctaatagcattattgaaaaatttaatactcagtctcctagacttttatctacacttttcaagagtaagatgaataatggagaaacgaatcacgatttaccagatattcaagttccggatacgccagattatattagtgaatatcatcctaacttatgtgataatagctatttgaatccttcgaatgaagtattctttgattcaatcagagagtacatgtcgagttatattcgtagttcacattataatggaaaatcacgtgaagatatttcttcatatttatcagatttccgcattaactattcatacagattctgtggcagaattcttgatacttggattgccattggaaggtcacttggtaataccttatttaatcagacaagaaatttaagatttcataactctgatacatcatctggtacattctgttccatggttgaaattatcttaaatttaccatcactgcttcttatttctaaatcaggtgataatgagtttaagaagatgcttacttgttgccaacttcctaagtatcgacattcgcattatttccttcagattatcaatgacattaattcctcatcggataatactcagttacttattgaaaatgaatatggatcttatttagctaacattacacttgttgctactagtgatttttcattatctaatattacttctgtgattgattttattgcgttgaatactgcgaggtggacaaattcattctcagattcttcgtatgaacgcgattaccaaaccactcatattttaggatcatttaaggattacggaactgaacaaattagtgaggcattaagtaataatggacctatttcaattctcaatagcttactcaatgaaggattaattattaatgacctcattagtgacgatccaaaaaaattttgtcgtgctatgaaacgacttagtagatttcagaaattatggcattcttattgtaacatcacaaatgcaattgaaatgaacccacatgattttttaaactataagtcaagtaagattcagtattcaccaattatgactggtttctataatgaacctggtaccgttgcgtatactttaagacatggtgtagcgaacaaggaagatatctgctactctatgatgtttcaaacaactattaatttagaattaagctcgcagtttgcattggattatgctaataacaagattaagagttgctcaattgactttgctggtaaaatgtgtggcgattctacatttcataatgttattatcgcggcttatcatggtaatgatagaccgattacatggaatgtttcctataatagaatcttccgtaacacaactttcattcctgatcggattccattagatgaggaagtagtagcatcaagtttggttggtattaagaagactaacatgagcagtaacggtttaagacattcatcattaatcgtaatgcatagctatggcgatattaattatagtattattccagcgagatccaggtgtaatgaaattgattatgacgtcaaattagaacattatgaacttgaaagaaagtattattttacttcagatgaaggagactatattaatgaacgagatttcatgtattttcaaacttatgattgggatattaatacatcaccatccttagtttcagaaatgttcgaaagattcatttggagtaagtttgaaaattatttatatgttgccaaacatcagaccgaattagatttccagaagcaatttagacttaaattgattaaacagggaattaagtcagatgcatttgaaaacttgtcattaattgctttaactgattcagttaacactaatcagccaattatgttccactgcagatattataccattacaaatattttcaatggtgctacaattaagactagagatccacataatgactttagacttaagacattcatgactagaaacgtggatgaaattcttaatgaagacaagagtcgaattggtgaattgacggtagcatttatgatttctgttgaagttctggcaactgtgacaggaaaatatagagtgacatcacaggatgatagcaatgttatctctatcactgatcggagctataacaatgaacgtacattatggacgaaggaagtattgccaattggatttattctcattgactggaattggattaaatggacaattgagttcaatgatgaaactgtcacttagcactgacagcgaaattgtatccataactttaaagtaataattgtcatacggtacaaaatgaagaaatgttattgattaaattaattcaatggatcggaattgacaaatgattaaacagtagccactggtaatagtaactaatattatcagtgaaagtgaaatttactatagcgatgtgaacacaactaatcacattagcagaaacaaattaaatagttgtaaaatgacttaaggtagtcgattatttaacatcatgatagatgtttataaccccccccc

SEQ ID NO: 211 - DNA, 2450 bp, Unknown
  derived from dsRNAs of unknown virus
gaatattgtctagctaagataagatgattaagggtcagattatgaaccgatcagacttcctatcaggaagtctctcgcaggaacgtattgacatgcttaatgtaaccacacttggtacatctgagagtagcaaagtcgtcaccgccgcggcggatggtagcgtcacactatcgggggctttagtagttggaggtcaaagcttcacaggcgattcgcagggattaaactttggcacggcaacttttagcagtattaacgcacaaacctttttaaagattggtggcacgaccgtatcatcaagcgcatctgagctgaacatactggatggggtaacagctagcacgagtgagttgaatgtactgactggtgtcacctccacagctgctgagataaataaattagacggtgtgacggctacaactagtgaactaaatatcctagacggtgtaacatcaactacagctgagctaaatatattagacggtgtgacggctacaactagtgaactaaatatcctagacggtgtaacatcaactacagctgagctaaatatactaagtggtgtgacagctaccaactctgagctgaattataatgatataaccactcttgggacgtctcaaaatggcaaggtggtcacatcagcgacaaacggaaacatcatactctctaacgaccttcacgttaatggacacacctccctacatacgactgacgtctctgaattcaggattagcggcagtacgctaactgcagatataccagagctaaacaaactagatggatgtacagccaccaccaatgagctgaataaattaagcggcgtaacagctaccacctccgagctaaattataacgatataaccaccctcggaacatccgaaaatagcaaagtggtcacagcagcggcaaacggacatgtcacactcacaagtagcctttctgttgcagggacctctacactccacacggccgacgttactactttcaggattaatggcactacgctaactgcagctatgccagagttaaacaaactagatggatgtactgccaccaccgaagagctgaataaattaagcggagtaactgctaccacctccgagctaaataaactagatggtgtgactgctacaaccgctgagttgaataagcttaatgctgtcacaacaaccacagcagaactcaataagctatcaggatgtacagcaacaacggctgagctgaacaagctatcaggatgcaatgctaccacgactgagctaaatattctatcaggagtaacatcttcatcagccgaattaaacaagttggatggagttaccgccactacaacagagataaacatcctttcaggtgtaacagctactccggccgaaatgaataggcttgatataactactttagggatcactcagacatcaaaagtagtcaccacggatactacgggtaatacactgtttgatggcaaagtgtatataggagacaaggacaccatacagacaaatgctccattcgcaccactccatgttgacacaagtagtgcgattggcgctgcctcaaccgctaattggacacgtctacgaccgggagtatcaacgaccgcctccgataattccaatgtaccgggtattgagtccagttcaggtaatggttttggaacaacatcgattctaagtgtaggtagaatagtcactcaggacgacttcctcgcatttgctggaaccattaatgcctcagatggacgaataaagactaacataacagacgtagttgaccaggatgccctgcgcaccttacgtcagctttcaccaaagaagtacgaatatattgacatttcaagaaggaaaggcacagaaaaggtgtggggttttatagcccaggatgtggcggaagtcatggaatacagcgtggaaaaaggtataagcgtcattcctaatatatatgcgatatgctcaaatgaggagggaacgactttaaccatgctatccggcactacaagtatattccttagtgacgatagtggctctttcttcccaattgaatttcatgatgagcgtaacaagaggatggaaagaagaatagtagctatcgtcaatgacacaaaattcaccatcgacgagccactcccagtggagaatgtggatatttttgcatatggacagatagtatcggacttccacttcctaaagaaggaagccatttttactctgacaactgcagcggtacaggaacttgataaacaaaatcaagttttggaagcagcgaatgcatctctacaacacgaattggagacactaaaactgcgattagataatgccggaatcccataatggtgggaaatggcacgatcttaaaagagaatacgcgaaaaggaagtcgcggtttcagttctatacccaagaaatcatccagcttaccactgttcaacagcaacgcatgaaaacgtc

SEQ ID NO: 212 - DNA, 1337 bp, Unknown
  derived from dsRNAs of unknown virus
gaatattatacgcagtagtaaaatactggtgtattaattatatgtttgttctgtacttaccttacggcgacgagaaagttataatctgtggagtaccactagacctgtgcctttacgttttcaggaacatattcaaagtagctaaaggtctacatcctagcctatataatcacgaggacccaacgaagtttaatccgttaaactcctggattcgtgtaaaagttaagcaaaagatcgagagcactataagagcgataactggtggagttgccttattaaatccagacttcgttccaactttgaaatctctgtactctgagtcagtaattaacgactgtaaagtgggatatctgtatcttgattgggatcccactctatcatacgcgaatcatattgatgaacatcaagtacttgaaggcgtttacaataacgactcttttgctgctgaagtgctggctggtttacgtaagcactcaattccgtcgaggctgccacgaccaacgatagaggaatttctaaaggtatcaatcgatagcgagctgcgaaacaccgctggattacaacctatatctcgctcagcgcttacaaaggaagcaaggactataatcagtaaatacgcagatttcacgtggacaaaatgaccgagcataattggagcagttatgagcctacactaattaggattaagcatagctgctttgcaatgcatgctttatatcgtaaaagatacctgttatcacgtgagcgtgtcatatattacgatgttccaatcatagtcctatcagcaatgactagtgtgtttatcgctggcgccgacgagtggctggcttcatccattgttaagattctcacttgtgttacctctttgatagttggaatagttggtgcattaaagaaattctttaaaattgacgaaaaccgtgaaagctgcctggaaacatacaaggatatgttcaggctgttttgtgagttatcaatgatgcttgatcaaccccctgcttctcgtggagtagacgcacaaaagtattcaacagaattagctaaccgatactcagaaatcatggatagggcgatagtacttgaagatgtgagaacaatggagaacccaatatacaatgatcgggctcaaatgccgacatcattaagaaagagattttccaaatcattcaaacagttaccgccaatgcctgactcggattcgtatcctcatgatcgtcaggagagtttagattcaataccataattcatacacacggtgctgatgtcgacagtactgaattactgccttaatggggggaataccctcgctaaggccatgtctgcgcgtatgaaacatc

SEQ ID NO: 213 - DNA, 1425 bp, Unknown
  derived from dsRNAs of unknown virus
gaatattattgtacttacagaaattgtagatgtaagatcagtatggaaaatgaacgtcgtggtagaaacctgattcgtcacacctataaatcaggtgtgaggggaccggtaacgcccgcgagatcgccgaccgccaccgaatcgtcaaacaaatctccaagcgctggtctgagtcctactgacaaaacagacgtgccgaccgtgacgtttgaagagattattccgacgagacccatagacattcgcaaacctgaagacctacaagacatccctctactagcgtcaaagcaggatttggatgccattaaatcaggaaagggagatgactacgaagtagtacttgtagagtctaaaactcttcttccgcgtgatgtggatgaggctattacgtcaacttttctaccaggctccgatgttactggtacaaatgaactcgctaacattcttatagctagtggaggaattgtggctgcaccgggtgtgcctaagccaaacgcagtagtaggtattggaatggcaaaatcaggagatataatcaagtcgcttaacgaaggtgactattctggagctatcgttgacgcttcgcccataactggactagctacggacaaacaatccggtgcattagaccgtctagtaaagacttttgggttagtaggttcacttgtatcagctgacttccctggtgcaggagccaatataatgaccccgtcgccaagtgcagatgagagaaagccgtcagagcatatgggtgtaattggaagcgaactagcgggctatggtgaggccgttggatcgggtttagtcactgggttatccaatctcgacaaagttggtgagggaatacaggtacttggagggatttttagtgcagcctcaaaatttgataatatgtcggaatatgtacgctcacttccaggtattcgtaagatagaagaggatagatactacactgtgtacttttatccaaggaaaggtataacgtacattgaatggaaaccaacagaagatgttcgtaatatattatcaaaatcaaaatttaagaacgtattacgtgagtggacagaggattttattgcggccgctggagtgagagtgccagcctggtctcgtcgcgtgaaatacataacctcaaaatatggaccagagagtgcaaatgtaaaacactacgggtactccaggggtggaggtctggctactcacttaggtggcactgggtatggcacaggatatttttcatcttatgctcccacccatacctcgaggagtaaactaagtggtgatgtaatgcatgatttgataataaacccaatgtcgtacatgctaatgcttcgcaaaaggatgatatgaatcataacataacgcttcctacatctaactcgctattctagctagcgtgctctgctttgtgctgtatgaaacatc

SEQ ID NO: 214 - DNA, 1422 bp, Unknown
  derived from dsRNAs of unknown virus
ggaaaattttttaaatgatccaagaaatcttcttattcctcttatagaagcattttattttaacaaaattttccatctagaagtgtctagacgtaaggggaattgcaacaagtgtacagattattcaaatcaatactttgaagtctttaacaatccaaggcactatgtttgaacgttgtttagaatattgtgaaattctaagctttagcattcatcagtacgttcagttagcaaaagttgatatgtatgtttaagataatatcattttaaaatgcatacataaatcactgtcatgtattacattaaatacaattattataaaatactggaatatgttattacaaaattttagactgctatttagcgataggtttactcttaaaatcattccttctatagattttgaccatcaatttgactatctttgcgaaaagattagactgcaacagaattcaaaaataaagcctgaacatttcaaaaatattttctacgctcttctctatgtgcggttaaaccctaagaatgacgtttcaatgaatattattagtatgttatctcacttatatttaccaggcggttttcaagagtgtatctctttcatcccgctcagaggccaaatgtacaatataaaaggtacaactttaactttcgaacttcatgataaggtcagagaatatgttgagcaaaattatgataacggtaagttattatcaaatgcaagttatttgtctcgtgagctaagtttaaataaaattgctctcagatctaaattcaatgagagaatcgtttttggtactgatcgaggttttttacttaatagttttatgagctatgaagataagattcctgagttgggagcgatgccccaattaatgtatgtcagcaatgcgcttccgaatgtcaatgttagtgtagctgtttctttactttttggattacattgcaatgaggagtctgtccgtagtttcgttggattagctggatgtattggtgccgttgaattctctgagcaaggttttctccaaaatgttcgcacttctatagacatgctgtttagatttaatggaaaggataagtcctctgatgataaaggagcttctgataaggtaagtcctgttaagtcagaaattgacaagtctgcttacaattcaggccctccacacagtgggaataactattcagatagtatcgttcaagtaagccaagtaattaatgaaagattgaataggctcgagggaagcttttcaagtttgaaggaaatcatacggaaggatatttctttacgcgatccaacccttcttactgaaattacgtaactatttgcatttagtgctatcgtcagttgtgttatgcgtggctgctagctggatgtcaccagaaggtgatgagaagtggatttctacttaactagaaaccccatcc

SEQ ID NO: 215 - DNA, 1735 bp, Unknown
  derived from dsRNAs of unknown virus
gggatttttcttaatacacgcggaactaactgttgactatggatggcaacacactgttagatttcgagcagttcaaagctctagacatcaatgagcagtatatgaactatgtgagggagtacaagtgtaaatgtgatgcgaaagtgagtttgattgctgctgaaaggtatggcttatccagggagcgtagggcaaagagaggacttgtgttacccaaggggtttaatgatctggagagattggatcagggcatgatgattgtgatgctgaggaaagttgagaaggcgattgagagcaattctcctgataccaacaacttgatttacaacttgaaggaagagtgcaagacaaagagaatgtcctttgaggatctgaaaagtttcacgtcagatagcctggtccagtccaccttgaaccagttgagcaggtctgatttgtgtacgttctttgctctgatgtgtgatttgctcgctgaggttaccccagtgacacgcaagactctcaagactatgcctcttgtctcaaatgaagtgtccactccattggataacataaaggtcattaatcatgaggttggccgtgtgactgagactaggtaccacaagcactcggcttccttcgcctcattgggtgagctacacacgcttcagcatctggatgtgatgagtgatgagttgggtgtgtataatctgggtgtagctggcacgatgtttgattgtatgtataaggatgatgagggtaaggtcatggcttgttcaagtataagtagttggaatgatgccgtctccttttgttctttgatgcccaggatgtcgggaaaagatgaggtacacacgatagttcgacggttggcaggtcttcctactaaagctgtgttatgtaaagatgcgagcattccacacgtgcggtaccatgtaggacgtgcgattacgtacattttgtctgagtacgctatttcacattgcagtattggatatgatgagatcggagctcctacctttacatttcatgctcaacatgatgttaagcgcattcctgtcacctgttgcgcaagacccaaacctgtgaaatcacagaagagagcgaacaacaatgtaggcaaaaggcattacaacacatggagatggctaggagattcaatcggaagcgtagagacaccagtcgatcttggtcatcataaccggcaagacagaggtagacgtagaaggaatgacaaccaacgtcaatgtagcatcaccagatccacaatggtgtgtgctactcagactgcacagtatcagactgcacaatatgagactattcgtacagtcatggctccacctgtctcagcttgtgccactcctttgcccaacattgatgatgtgcatgagtacccggctcttagcaatgtagcatgtaatagcgcaatcaacatacaatctttttctaacatgacgttggatgcttctgcttactacccagcttattaccaagcttaattatgcacttatatatcggactttggatgcttctgcttactacccagcttaattatgcacttatatattggacaaaagctgcaccataatatctacgtaagagcttagattatatagactgacaacagtgttaagtccatagaatcttttagttctccgcgcccggctgcaaagttccttgactcgcgaaggggagagttgcgctccttactcgcgagtcttggacgcatggcgcgcgtggcattatgatacagacc

SEQ ID NO: 216 - DNA, 2854 bp, Unknown
  derived from dsRNAs of unknown virus
gggtttttttgccgtgtcaaaactgacacatttatattgaaaagagttactctttttcttcttcgtgtttttccttttttgcaattataatccaattttcaaagatgtaccacaactaggtggaatggtattagactcaaatctgccctaatacctacttatttatcagctcacgcttttaacaatgttaattatatttaattattcaactttacctaatctctcatctttctcttcacttactagtcgcagatattcacgtattacttcacatgcttactctgccattgacactggtgcaagtaatgctgctaagtatgtaaatggcaccattttaggtaacccagaaatggtagcttacactaaccaatcaaatctcgaatctgatgtcccactttcaactgaccaattcggtttaaactctcattcagactctggtctctttagaaactcagttagtaattattcatctcgcatctgtactcagttagatttatggactacagaatctgatccagagatcttaacttcttcaattcaaccaaaaacttattcagagttaaccacagattcaattcacctttattctggttattcaatctgtgaagttatgaatagatgtagtatcagagattttacctcatatagctcaaattcagctcgtattgttatgagtagtattaacgcattatcaatgatgcgattatctatctgttctgttatgcttaagaattcgggatcatcaatcctcaacttcaacacatgttcagatagtgttatcagactcacttgtcacattagacgattgttgagtgcatccattagatcttcatctgttaccacaactgatttgttccagcataacagtttacttggtaccactaagatggaagaaagtatccttaccagtgatgtcgaacttttcgcacatcatgaattatatattggtggacttgacttctataaggagcagttcattgattctttcaaatatatccctggtgaatgtgatatgacaatggtaacagcacttgccgaacttattttcactattaatccggatctctccagacgtaatattcaaaggaaggttccatcattaaatgcaactgattgtcagttattatctaatctcttgtcaaatgcaaatttaaacgtatttagatcagaaattgattattcacttaaggatactgatattcaggatattatccgtaccaataatactgtgatggaatggaacggtgacactggtatgaagtcaacactcaatcaattcaagtttgagaagaacagctctgatgttagttggagtaatgtatcttcacttagacatccaaatgcgatggtgttaaatgaatcttatgacgttaataacatttattacgcatatgtatatagatttacacttgcagctgatatcaatactcaaactatgcaattctgcgaatctgaatatactgaagttagtgattatagtaagattattaattccagtgataattataagtggttaagtttggtaatgtttggacacactttcgaagctaattacgtaaaattaccaaacaatccaatcacatttgctgaaatggatgttaattatacagctattaaggcagcatatccatcgttaagagtagcagttttaagtgactcaattcgtagattcgagttacttcagatcgataataatccatttaaccctaatgattatacaaagatctgcgatatgtctaatgacgtaactttctctagactgattgattctgatattgttgataaatcagacattgttccaacattgagttcaactgccgctgaatttatcacaagttcatcaagcaactcagaattaagaagtgtagctcctaatgatgcacattttgatttatatagtgcattaactgaggtagaagttaagaatcttgatttcgatgcagttcaaatggttcttagcctcccaaaggtattcgaacaaattacagctgcagcagctcttatcggtgaaagaactagtggtagaattaatggtaatcagttatatgttaatttaaataagaatgtgcattcacagcttaattatttaaataatagaagcgaagtgcaaattagtattggtgaatttaaatgtaacaccagtaatgaacctaaatttaacattggtaccgaagttgttaaaagtgtagttattaaacataattacggaaaacaatttctgaaccctacagatattagaaatattatctctaacgttcccaaagttgaagattcatctaatccatttaaggaatcttatgtattagctgtttgtcttccaacatgtacagggaaaactaccatggcgaaggaatatccagaatatctcgtcgatattgatgaattaatcaacaagagtgaatataaggatgaaatggcaagaaatagaaatgatctatttaataatcacaatgaaagtgaattgatgagttatctagaaaatgaaagctatatcattacaaagattgttaatcaagctttactaaatggagaattgaaatctagagtattgctgattcatgctccaatgcaggttagagaaattccgcaaatcattattgcaggatgtctcaaattaacacctggaaattgggattcaaatattagcatgagaaggttaaaagcaaaaaacattaaaaaatttgatcgtaatgtagaattagctaaattaggatcaaatgaatatattgaaatgagtcagtcactcattcaattagtaacagtacttatctcacataagttctgtaaataaatgactaaatgacaaaggttgtcgaataatattcaattaaattgaattttattttcccccccc

SEQ ID NO: 217 - DNA, 2725 bp, Unknown
  derived from dsRNAs of unknown virus
gggtttttttgccgtgtcaaaactgacacatttatattgaaaagagttactctttttcttcttcgtgttttaattttttaatgcaattataacccctttttttaaagatgtaccacatctaggtggaatggtattagactaaaatctgccctaatacctacttatttatcagctaacgcttataacaatgttaattaatttcaattattcaatcttacctaatctctcatcatactcttcacttagttcaaacttattcgcaggttctaatgatgctcagtgctatgaattagcttataagtcatcgattgtgttaaatgctttaccatctgaattaccaagtgatgaagatgtagaaaagctcatctctactcagcccgttaaatctactaaggatgacgctcctccagaaccagtcaagactcctactgaaaatccagctgaaacttcatctggcaatacccctggtggtaagcctgccgaagaagttactgacatggataatgaacttactagtaagagttcacagaatgagcttgctgcaaagcaaaatgctgctcaagctgctgatatccttagtatgattaagaaggctatgaaggattctcaatctccgactgaagctgctgctgaagttgatgaaccaattcctaactatgtgagtttcttagagccatcctctccgattctcacagatgaaaatagagatatttctaatcgagatatcacattgagtgaacaaaacatcactaacttcactcctgataagtttcatcgtagtattgaattatatatgaaaaataaggttagatcggctacagtgaacggtgaaactagatcagacattagctcatatttaaaaaactttaatttcagttatacttatagcatttgtacacgaattttcgaaagtatcattgctgttggttacgctgcaggtgaagtggtctttgcaggtaataagaatgtaaggtatttaaatgctgactattctccaggtttattaggagcagtatcagaatacattcttagtcttcctagtttattcttattaactaagattaatgatactagctttactaatgcaatgtctagtcagcagcagtcaaaatttagattcccgcagatctatgctcagattgctcatgacattaacagctctaacgaaattactcaggtgtcaattgaatcagatgaaggtagttacacttctaacgtgcgtttacaggcgtcaattcgtgataatttatcatgcattacttccagttgtatgactattagtttcatgatggcaaagtgggcatttgaattccttgataagccaatgaacactacttatacagtgagcagagttatgactgataatgtatcaggcaataattctgatactaatcgtcagcttaactctaacaatcctgtcgcagtactccgtacattacttcatgatagtttatttttaactaatcttacaagtaatgatccaaaaaagtttgtaagagcactcgcatcattatataagtatcaaactgtatggtataactactgtggtgttaagaattatcttcattgctctccatatgagttcttaactttcagatcatcaactattactacatctccagtaatgtttggttctgctgttgagtctggtgaatttgcaattacatcaagattctgtcctccttcagaagcagaaatgaactactttatgttgtatagcatcactattaatccagctaatagttcacaagttgttcaagattttatgaactggaactatagattcacacatgtgaactactcaactaagttagttggtaagcaatccttcttacaaatgttaatggctatgcaacatggtaataaccaagaaatggcctggccagtagcttataacaatgttttaaagaatgttgtacttaaaccatctaataagccaaatacccctaacttaggtaatactgatagcgatacaattgcagctgcatcatatgttggtatcaaacgtaataatgatgaaactagattaagttgtaatcatgacagtagaaacaataatgacgtaactactttgaatgatggcagtgaatcagattcagaaacaattgaattcacaattgcagctgcaacatatgttggtatcaaacgtaataatgatgaaactagattaagttatgatcatgacagtagaaacaatagtgacgtaactactttgaataatggctgtgaatcggattcagaaacaattgaattcacagcagtaaatcaagattgtaaggatgcaattgtgagaaatagaaatgacctattcaacaatcatactgaaagtgaattggtgagttatcttaaaaacgaaagctatatcattacaaagattgtcaatcatgctttactaaacagagaattgaaatctcaagtattgctagttaatactccaatgcaggttagagaaattccgcaaatcattattataggatgtctcaaactattacctgaaaattggaacttaaatattagcatgagaagggtcaaaacaaaacacattaaagaatttgaacgtaatatagaattaattaaattaggatcaaatgaatatattgaaatgagtcagtcactctttcaattagtaacggcacttatctcaaataagttctgtaaataaatgactaaatgacaaaggttgtcgaataatattcaataaaattgaattttattttcccccccc

SEQ ID NO: 218 - DNA, 5370 bp, Unknown
  derived from dsRNAs of unknown virus
cgcaaaagagcgaggcgtggctcctcttttgctggtggaggacccggaagggaagcggaactggtgttgttagtggacggaggatacagcgatatgaggtcgagtagtaggggaacaagtgtggctaggaaaaaacacttcgaaaaccgtgtagggcccgcacaatcgatcttcccgatgagaccccaagatagcctgggtagtggagggaatttggcgttcggttgcgtccctcggggcgtcatcttaaggagccgaggtcacctgaaactgcgcgactccaggaaaacaacccatatggaaattcaccaaaatctggcagctccctagaaggagcgggggtaggcgcgagccgaggttagtagattccacgacatggcaactactagggcggaagccttgtgggatgatgacccacaccggccggaaggccacaaaaaagagtatgaataaagtcaataaagaagaaacagatactctgggaggggacaatagtggggaggacacagctggaggcttgggactgcggtcaccgagcgggccaggagagatggatacagtggtgggcgctggcgatgcagtgcccggggagaagaagaaggatagtagtgacgatactgaggacgcggaggatatcgtagccgagaaattgttctacagcctgttgaaaatgcgagcgacatccgccgccacaggggagcatagagttattgagacggccagtggggatttaggtgcgttgagggaccacatcacaacagcagacaggttgctccgaaagttggtgagggatgctgggttgcccgggcctgagcttgcgttcaccacggcgcaggtggagggtgcggagagctggaagaagttcgacgtgaccaggggtgccgcgtaccgggggacgggatacgccgctgaacggctgaatcagcttgtggcgatggctactcccatcttaaagactggtagaggtacctcgctatgtcggatgatatacgaggccagaagggtgtgcgagtacgggatcgctgccttggccttcgagcagggcggagcgttctggcagaatttcaacataagtcagttcctgcaagccgatccggtgacgggagtcttaggcccggtggacttctttgacgtcacgaagatcaccgactactttggcaggttcgtcagtcctcaatttggggacacggtggcgttcccggttgtatggcccaacgacatgccaaccaccaggggctatgcgtggtttctggccgggctgtgctgtcaggggctgggaagggagatcgtgttctatcacggtgaggctctcgacttgaggcctcctttgcctgcgtccgttagaaggataaccaaaaccgtgaccgcctggctagaggagcacgcgacggcggcagagaaggctctgtctaacacgatcctgtacctcacacagggcattgtctgtgagatcaactcgtgccacatagctgacactgacgcacgcgcggcggtccgcagcgtgtacgaagacgcggtggactgtgtcgtgtttccggaccgagtggttctgacgcctgacgccgtcgccgtggctgaggacatagcagacgttcctgtggcattacccgctacggcgagggcagtgcgcgaggctgaggtggcccggaatgaggcgaggcgtgagcaccaagacgctgaacgtgcgcaggagagggcgcagctagcggtcacccagctagagaacaggcgtgcagctgcaacccctgccggtcacgggggtgcagcgcacgccggtcgtggtggggggagagcgttcaggggagccgccgaccccgagttagcacggttgcggggaagagctagccgcgcccaggacaggttggatgaggccatactggcccttgagaacgctgaggccgtagtacggcgtgcggcacaagcccacgggaacataccggccgattgggatccggtcgtcccccgcggtgacgctgtgggtgtgttgcctagtgaccacgtggtggattattcgctgcccatggcatcaccgctgggactgtttggtcgtgtttcgggcagggttcagccgctggacagggatggtacacagatgggctttgctgaatcggatgctatgtttacccttgcgtacatttactcggacatgggcgctgtgagggcgctccttccgttttgggagggatgtgagaacgtgcgtagctacatggcagccggcataaccaggacctcctatgagctaaatgaccagtggcctgaattcctgtcctcgaccttcgtgtcggaggggatgattctcatgtcctcgcgggcgcatgccgactgggccagtggtgacctgaaggtcggggttaggaggcctcaggtgcctagggattgggttccggcagccagggacgagttctggctaccaccgtggacgcagcccaatgtcataccggttgccatcttggcccaggtggttgggaaagagtgcctatcgataacggccatgacggagccgtcaaccatgttaaacgtgggtgtggaccgcgccggtggccggtcgaccgctgtcgtcggcaagctagaagacgccgtattcggtaggtgggtgcctaacctgggccaggaatttctggctgtcagtctgggaaatgggcgcccgctacacggcaatggcgtggctggttgggccctggccaatccagggatcatcacgaccttagtggtcccgtacgctagccttattgacggcgacgctatcaccaccacaaccacctggatatctatgagcaaccccgtagacaaagcgggttcatgcacctggcaggacgtagattcagagacaattcctgccttgccgttcgccactagtggcgggcggcagcgtagatttcggtcctaaaggcttgcctttggaccgggggggattcgtggatttcgtgatgagcgggggagcggagttgatgcgtacacagggcgcgaaacgggggtttggccagttgtgtaagttgttagttgcgatggctggggcgggggaggaagacccgctgggcttgtacaagctggagtggtcggaggggtggttgcagggcggagttcaggagaaacgtaggaggttgagggccacgtggggcaagagggttggttggaagttttgtactcacgctgtattgaatgacgtgttagctggttacatgttggcgttaccgaagggactgcgtggtgagttcttggcgctgtcggggagggtcgggctgcatgaggcagaccccacgacagtgctgaggacttgtcgctgtgtggcagttcacgcctttaagtacggttatacactatttggatctttgtggcgctacctggtagatctggacatgctgttcggatcgtcgacgcagggggccacacgtgaggaggcaaaagaggaattgagagattgggtgaaccgggagactaaatggagcggcgagaagtttgagagcatgatcgctacaggcttcccaatcgtggagggtaagttgcgggcggcggcgtcggcgtacacgaaggaaaggcgaggggcggctgagtttgcccagcgcccgtcggagtgggtgtcgcctggcgctagtactgttgacggtctggtcggtgtgcggtccaacaagataagtacgtggatgaagtacgcagctaggatacgctcgtacttggagactggcgaacagcgctggagtgacagggccaatttgtggaggaacctggagaagcgggagaggaagaaagtgaggcagacggttaaagccagctttacgtctttcgtggaccagtcgttctgccttcagggagtcgaggacattgtcggtgcgggactgcgcacgtctttggggagtgacccggaaaaactgtgggaggggcttcaaaaagacgtgaataaacactacccagttccaatagacataccggcattcgatcaccgcccgccagcgtggctggtgctcaagtgtgtccggttgctgttggagttgtgttcggacggctcaccagagatggaagcgtctgccagacgggtgctacaccaaatccaaacgggcaagttgacggacggtgtggacacgtgggactgggaaggtggggtgatgagcgggtggagggtaactacggtgttggatacggtgatcaacgcttgtctggcatacggtacccgtactccccaggctgccgaccctgccactactggtgatgatgcgttgtttttcgtccgaactaaaggccaggcgagggaactagtgtctgagtacatggaggcggttggagtgaatgaacgtaaatttttctgtgacggggtgcgtggcgagttcttgagatacctgcttgtcaaaggcgctcgtggacgggcgggctatcccgcccgcgccttctcaggctacgtgttcactcaggcgttctcgggtgggggggctatcaccgcggacgaaatcatcggcgacatggagatgttagtacagcggggcttatgccctgtggagttgggtaggcaggcggtcctaagactagctgaccacttcggtgtgtctaacttccgcgcttgggagttcctccacacccccgcctctgcggggggtggtggggtgtacccctgggctgggaactggtgggctgtgaaacgcgatgtggacctggttgttataagcgggaccaagttcaggcgcaggccgtgggacgacattccgggtgagaccaaaaacggagtgtaccgtactgcttccgcactcggtttgcacgcagaccacctgcgcggggtggcagagggcttagttttcaagaagaaggtggacggtgacgtaggtgctagagagtacctacaccgggtgcagcgcgttaatgaggggatgtggctggaggccctgggcttagaacgcacccgtaggccgcggttcactatcgacgggtggtttgcctccagttggataaggttccggccggacaggtggtgtgaggtcgtggaggattcagacttgacacgcctgaaggcactggaatcgcgcatagggaggggccgttttctggactggttgcaaggagagtcttgccccgtttcggtcaggggttcattctttggtagcctagatattgcagacgtaatgcagtacctgcgcaactggatacctaagttctctagcagagtgggtggcaatcattggatgggacgcattgtggcgactgagagtaggatcttgaacaatgttgttggaaggtggctggcgtagccagtcacctgttatgggagtatacatagggtgggtggggcccgcatcgatatgggcggtatactgcaaatgtgagtttacacatgggccccaaggggtcgacctaataggcgcgtcaataggcccatggcctgatgtc

SEQ ID NO: 219 - DNA, 2096 bp, Unknown
  derived from dsRNAs of unknown virus
gaagttcttgaacagtagaaggaaatctttccgcaaaaacgattgagagctttggatatggcagctgggatcattggtggagcgctagcgtcgcagctagcgggcgccgcggcgaatcaggcaggggcaattggcgtcgagcttattagcgagataacgccgtcgcgagtcaaatccgcgggcaagaagtgcggcaggtttctcggggggctgctctcgcagatagcgaacgacgacgattcgccagtgaatccgagtaccgcgacggactgcgcgcagttcgctatcagctttaactcggtcgcggtggtcgtcggggggcggatggtcctaccggagaaagcgaccgagtggtcacgtctgacgcgcggcgaggcgcgtgaacggctgatctcggcgatgcaatcgctccaaacaaacaaggagaagtttgtgaaggagttgatgggtaagcataaggacgcagctgttgccggcgccgcgggtcgactggcggagtcgggccgcggaagcctgtttcgggacctggttacggacgtgagctttggaacggatcctcagaaaccggcggaggagcagcaatcttctaagatgaaaggcatcagtggatccggtgcccttctcggcgcgatggacgcgttgctggacccagagctgggcgtcggcattgagaagcgcagcgactcgttcacgtccacgattcctatcaccgcggtgacgttttgttcgtcgccaggtaccggcgtaccgctggcgggtgtaggctcggtggctaatctgaacgtggatggcgaagacatgggcgcggacggtacaccggagcgacaggcatgggcggaggagaaccagagggcgttcaatctgctggatcgggcgaagggtgaacccgggaagatcagcgtaacgctggtcggcggcattgacatgttcgaagtcggcgggcggctgtggaatgcgacggaactggtggattcgggtcgactggaaacgttgatgaaaggtaccgtgcaggtgtccaacagcgaaccggaaccaggagagcccgccacggccgtcgcgagttttggaacgattcagttcccaaaaccgcagagtgtgacgcaaaccagcaatacagatgtgcgagtatcccttgagctgcgcacgtccgtgttcatgtcggccaagggtccggcggtgggtgataacaagccgaagtcgtggtacaagaccgtcaaacctgtcagcgcaattgccgtcgtttgcacgacgaaaggtaagcagagcgggctgtccgataagctaacgggtagcgaacgctcgctgcgcgcgtccgtggtgggcattgtgcccttccggcttacggccaagcacagcgccccgggtttcgacgccactacggtatccgaatttgactacatgaactatcagacgttcatgtacacggcgacggtcaacttctcggcggaaatgccggcggacaactccctgttcgtcgtgactctgctgaacccctcgtccccggtggtcaacggcacggacggtttgtattacaacgcggcgggagatcgccgttacgcgcccgagatcccgaactttgttgccccaccagggttgatgatcaccccaaggacgtcggaccggcagtttccatccatgcgcacttacacgcgcgagggcgcgaacggtctcgttacggatagtacagcgggctggacgcaattcctcaaacctgcgtcgacggggcggatcgcctatatggggaagcaggaggacggctcgcaccgatggaaggagttgaaccagtcactggcgtcaatcgtcgggcagtatcaactggacggcgttgcgcttaacggggagggcgaggcacgcgcatccatcgggatcggcacggcccgtgaggtgttgattagcattcagccgaaggaacaactttgggacgagtttgccacatacgcaagtaaaactctcaacatcgcattaccccggtctttcctggagttcgcaagcgaatatgcggacgaggagaccgtgggcaaacttcgggaaatccttctgagtggagcggcctgggtccgtaagtgattcaccacactgtaacataggagttgatc

SEQ ID NO: 220 - DNA, 2054 bp, Unknown
  derived from dsRNAs of unknown virus
gaatataaaactcgtatctgttgtattaaacacattcttaaagcataatttaaaatgtcttttattgaggagactaaaaagtacgctactgaggttgcatcggccgccctcaacgcattcgagcagcaagcgcgcggcgaccttgaagcgccgaacggagatgacaatgttcgactttacaccgctaagggtggttcggccgttactctcgcttctacgactacatctgcgtcggtgatttacgatccggaatcttctctgaggaatggacagctcaacgtcgtcgtatacggtaggaactcggcaggcacggttaccgaggagcagcatgtcaaccttggtcgcccaacgagcgagttcctctctgtgggatgcttgagctccggtcttaaagtcttcaactcctctggtgtggatgtgattggcggtactcagacggctgctgtgctcacctccatcccccgagatgtcgctacgatctcgtcgactgatgtcgctaacgcgtgcgctagccatgatcgtgacatggccagtggtgtggtatcccgagaagactcaaccctgacaattgcaatgaccgagcacttcggcaagaagatggctctgagccgctcgaacaccacgagcaacgttgtctcgcgaaagtgggatgatgcagtgggttcccgtcggactacttctggccagacccttggtttcacggctgacacagacatgactgtggggacgaccgatctgacgtcggcgcagatcctcgctggtgatcaaacgaaatttatcgttgacactgacaggctcgattccgcgaacaaccctctcaccctggctacatacaacgttgaagcatcggcctacattgaaatgtctactgtcgcggttaacaacaatggtcaaacgtatgacgccatgcttattgccctcgacgcggctggcaacgtcctggatacctccaccatccgtgatcgtggatccacctctactggcgcggtgttcgacatggttttctccggttctgtgtcgagctctaccgtccccattcatcgtgtggtgatgtcggtattcaagtcttcgcaggctatggatgacgtgatcgctgcggctcaaagcgtggcggtggtcaccgcgcgcgaggagacggctgacatcgccgcacgccccattcacgtgtgtgttttggagggacttaacgcctcagcgactctcaatctcagctcgactgctgtactcaccggagtccccgactcgacgaacgtattcattggctccgctcaggaggcgcctagggtgttcgatacgaacgccgttgaagtgttcctgaaatccgtttcgcgtgttctccctagggcgtttactgtgtcggggcaccgagccgtgacacatgagatcaaagcgttctacgaaggtgaggaagttgacatgtcgttcaaggcgatgtcattcaagcctattgctgaaggtatcaagaaaatcggcaaggtcgcaaagggaatgacccctgagatcgagatggcgcttcgtggggcgggctctatgttatcccccatgcccggcgtggcgggtgtagctggtcgtggtatgctcgccggggctgaagttgctaggcgcatttgaaccgtagcccatttccctagtgtgcttatgatcaatggagaagttcaccccggaaggttgcatagcttaattatgtcgaacagtgcgcttgatagaaagtaccgtatgatgaatggcgtggcgtttgataccaatttaagagacgtgggcgaagcgatcacacgtatgttgcgtgattacggcattacgcatgtgtcgttgaaacgcgataatgtcgttgaaggcagatcatgggagatgggtgcagctaagtctctacttggaattgaggatacttctactggtaccgtgctcttgtatgaacccaatgaaagagtaaccttcggaccagtgctaggtataccaacaaagagatatatgattacaaacttagaagatagtgatacaacaccatacatcgcgctttcccggtgaggttatggatatacagtttttgaaacatc

SEQ ID NO: 221 - DNA, 1578 bp, Unknown
  derived from dsRNAs of unknown virus
gattgttgacgttgaaagtgaacgatggctgcacatgactctactccgggtaaggacgtgagtgctgtgttcgtgaagttcagtgcgggtaggagaatgcccccccccgtggaggtctcagctgaggagagcgtctggcttagagctaacgccaaccccggcggtgatcccactgtgtatttcctgaaagcgatgactgatagtctcaaaggatgcaccctcgtgtataagctcgcaagagctatccgcgatccccacctccatcaaatggttaggcaggggatgataggcccacaggccctcgtcgatgtcaggagattcctgctggcacgtggatatgcctacaacttcgaaggtttggacaagtatcttcgtgcttccccagaccacctgcatgtcctgctatcggtcttatggctcgctcagccgatcattgtcaagtcgagaatgcctcttgacacgatcagacccatggctctgcccccccgatcagcgagggttccgggaatgtatggtctcgaacgttgctactctgccatcctcgccaatgttgagtttggtgtggagcgtgtacgtggtgagtctacggtccactattattttggtggacgtgttgttgagccgtccggtcacctgttaggtgctatggcggatcatcctgcatggtggcccctccgagtgggtcgcttcctctcgaaccacatgggcagtcggggggatttcgtttggcatcatcgtgtcgattttttggtatccatcatccagggactcgcctatgctaagcgccacggccttcgcgcccggcccaggatttggttccttgccctccgaaccctgaagttcctgatgccccgaccacagcgcaccattgcaacggagctgtggtccatccgtcagatcaaggcgcgtatcttaaggtacggcttgtactctagggaccatggcgttggttttgaattcctcccatggatcctgtactctatttcgggtgcaggaaaaaccttccacgtcgaccactcctcacaacagggacttgtcgacgcggatacgctcatatactacatatgggctatgctgacaaagaagttcggtgaattttggaagggtaggcccgctgataggaccgcgtcccgtgccattatcaacgatgctcttcgcacagcgatgacggaggagtttctccgccgttggggcaccgatgatccagtccgtgccttctataccgtcgtgcatggtgacaacttgaccttccccgacgaggaggaccggtcacttgtcttcatgccgacttttgaggatgtctcagcctacagagaggcgaagaagctcatcccgggcaataatcagcccaaggaaatatcccccgaggagtatgatgctgacaaggctaagcttagtcgtgtcgccggccctcgtggtttctttccttctctggcgatccccgaggagatgatgccagatcccctttctctctacctcaatctgcgctattccgacgggaatcatacgaattatttccgtagtaggcaatagcatgtgggggaacagctagcgggaggcgtcataacttggtgaacc

SEQ ID NO: 222 - DNA, 1520 bp, Unknown
  derived from dsRNAs of unknown virus
gaatattattgtatctacaggaattgtaaatgtaagatcgtcatggaaggtacaggtagaggtaggaatctcattcgacacgggtataaatcggggaaacgaggtccccctgcgacgtcaaagcctccggggtcaggtggtggcaaggtcaagccaccaagcgctggagtgccgcccgccaatgcgccagaagttcccgatgaggctgataagccagatgtttccgatgaggcagacactcaacaagttagctttgcaccaatcgaacctaagaggacaattgatattcggaagccgaaagaccttcttgacttaccgttattggtcacaaaggaggaccttcttgatatcacaacacgtgactcgatcaacatggacgatggatatgaggttgtacttgttgagtctagaccggtaatcccaagtcccgattcgggtgataatgaccgtcctacgcttttaccgaaggaatgggatgaggcaataacgtcgacgctacttccaggttcagatgttaaaaatacaaaccaactaggagatgtcctaataagcgccggaggtttagttgcggccccgggtgtaccaaaaccgaatgctgtagtgggtatcggtatggccaagactggggacataattaaatcgctaaacaaaggcgattatactggcgcaatttatgacgcatcacctattgctggcttgatgcataatgaacaatcaggagctattgacaggatagtaaaaaccgctggattggtaggatctctaattaccggtgatattggtggcgctggtgaaaacttatccacacctgctggcgaagctgacgagagaaagcctacagaacatctcgaagtaattgggggtgaggtggcgaaatgggcggaaagcgttgggccaagcataggggctgtactgtctggtgtggataaaattggtgaggataggatatttggtggtattttcaacgccgcttcgaaatttgagaatatgtcaaactacgttacgtcgctaccggggataagaaaggtagaggaagatagatactataccgtgtatttctaccctagaaagggaataacatacattgagtggaaaccaactgaagacgttcgtggattactgtcacgttcaaagttcaaggacacgatgcgtgagtggtcagaggactttctagctgccgcgggagcgaaaatccctgcctggtcacgtagggttagacatatattgtccaaatatggcccggagagtaaaaccgtaaaacattacggatactcacgaggcggtggactggcaacccacttaggtggaacaggatatggaacgggatatttctcgccgtatgctccagcgccaacgtctaagagtaaattgagtggggatacccttcatgatgttataataaatccgatgtcgtatatgcttttgctacgcaaacgtatctcgtgagtagagaataatgacaattgcatttaactcgctattctagctagcgtgaactgtgcagtacgatatgaaacatc

SEQ ID NO: 223 - DNA, 4334 bp, Unknown
  derived from dsRNAs of unknown virus
gaatattctaacgaatacaatgacatcaatttctcagttacaacgaaaacgtgaagaagtgttaaggaaaagatgccaaggtgcggaagagttcacaaacatggtattggaaggtgcgcgcccattagcgaaggaagcgatggtggaagttgggacatcgcagcaggatcaaatgttcaaatgtgcgaagtacttcatctcgataatcgagcgctacccggaagcgggtcgcgaggcgatggagatgatagaacagtgggcaattgccgatcgccgagaggagaacaggaacgtagtgaaggaagatttctttccatgcgtgattcgttccgtcggagagccagactttcagttaaaggacagggcactggtatttactcagaccgggatggacaaaatgcttgttgcagcgtcagctagaggcgaggaaggtgtaggcataacaaacgacgatttctccaatggattcgtaactaattacgcctcagctaaagagatcttgcgggtcgacgatgagcatgtggtgattcgcggtgttaagttaaagaagacaccagagtcagcgcgaagcggtgtaccccctgctgatagtgatttaagctacactgaatcatggacacaccgatggggtgaagctcgacgttacacgcccttcaacttgaccacatgttacgcatcctggatttcactctatgagtcaatgggttacagcgccagtaaccttaatggttggcatgaagcgaagaagcgtggtggacagcatttactaactggaacgctatatctatgctgcgagtgggcgtgtaggacgggaacgccaatgtcagcaaagtctaagcttggcgaggacggtaatgcagcgtctctgctaaaagcatggatagcaggtaccacgccaaagatacctcaatggatgaatatctggagggggaagatgagctatacgatggtgagtcagctagatgttcagtttaacaaaacgaatgatctaggcttaattgagtggtcaagacagcaattgtcaaaagagatcggtgctggtaaagatgggaaaacagctggtgttggaacaaaagtgccagaaacgcgcatgccttttgttgaacgtgcagacggtggctatccattacaagacgccgccctgacaacgatgggtccattacgtttgtggttatgcttttcaactgcgttagaggtgacaggttcaagtcatctcgatgctagggatatggactacggtccattcatggaatactacagaggtgtactcctatatctaggtaagtatcctggatcagttggcaggaagctcgacaaagtaatagtgcaaatgtacaggcttattgctgctgatctaacgattgagacgccaatgagtgaaataccgaaattgaacctcgacgtagcattcaaaccagagacaaacatgattgacatttatgatagatatgctcatgaaatcatcgcgtctaattttgatctagatgcatcagctgatagaatgaagttagctgaggcgatatgtgacaaggtaccagaggtgaaacccggactaatgcgcatttttaacgagtactcgagctctccggaagcacgagctaaatacgcagtgacgctgtttgaaacgcgagtactagatgtgcttactcatttagcgcatccaggtaatatcgaaggttacagtagatcatgcttaggtagtctaccagtaaaaggatataaatcgtatactcaacgtttgatactagaaggtatagatggcaaagctgaagaacgtgcggtagacgagttcgagagagagttattcacagacatcttggaagggatggaaataccctcagtggaagatttgttcatacagatgaggaagttatcaaactcgcgatctgccggaggcgataggattaattttgagagtacaccatcaacggttacagggatggaagatatatctgggaacacagaaggcttcatgagtaatcgcaaagatgtggttcatttctcagctgcattattaatgtacgcagagtacatgatgaaaagagcgacaccagaagagccctttccattaggtttgcgttcagtagccgctcgtgtactgcgttacatctataacttgccccttgttcaacagatcatacttcgtccaatttaccaacgtattaaaggatacatgagggcgagtagtgatggtttcctaattgaacaacgtgaaggtgtagcggtacgtgactctataaaagagataaatacgtcaattcaatgtgcaaagaatgacctattcgtcgtattagcgcacgatgcaagtggattagatcagcatatcagcgttgctcacagacgagtgtggcgtgaagtagtaggaaagcttttcgatgggatcccgacaccaggtttaaaagagctgttatactccaacaagtctaaagaagagctatcatcaattcccgacgttacatatgctgacctagtgaagaatgtgctatcatcgtgggatgatgcatattatgctgttgcaccaccaggagcaccgcagcaactaattcatgctgatacacagccatcaggagcaatcacgactggatcagacaatactattgtgacaatggcgatgttacgacttatggaaatgaagactggcatgacgcaattaagtcgaaacgtatggggtgatgattgttacgtactgcatcaagttccaaaggagacgcctattgtaccattagttaatgaacaagaggcgattgctaaaggtgctggacaagtgcttgggacagtgaaggattcaacgtcagggagagtagtccattttctgcagctattattcattggtggtacagtagtatctaggcgtatggcttacgatcatgagtccccacaaacagtggagcgaatgccaggacgcattggtgaatacttagataaagcgatcaaattagcgtcgcgtggaggtaataagtcgctactaaacatgctacagctgatgactatatctaatggtgcacgtacctcaatcttcggcaggcaagccatcactgattttaaatcaatggctgcaccgaatgggttgacgaacagaatgcttattggcttttcgcagccaaatgccaagttatatcttgaattgaaccatcgcataattctagggtcatcggaaccaataccagtggataaaggtgctattctagatacacctcgtgatattggaaaacgcgtagttgaagatgcgcaagaaaagccggttgccgtaaaactaggtggggtaaagatgcaaagctctaatggagataactttacgatgcgagagctccaggaaagcgcatcaggtgtgctacttccgaaagaccgtggttataaagtaagatccaaatcaacgctctatggcgtattagaggaaagtggattactggagcacaactactacgatgcagtaaagaatgccggaatggatgcgataggaaacgtgcttagagagaagcggctagcgcctaaattcaaagagaaagcgctaatgcgtagtggatacatctcatcaaaagcgaatcgtaccgtcaaaccatcagagcgcactcaaataatgtcctcactacacacaggcattaggattggatcaacaactataacgtactcttttgacaaatcgcctttcattatgtacttaccatatagtcgtacaaaagatgcttcccaacaatttgacagcacaaaattccacttgcagaattcaaacggatcaatatctcaatcatatgatacgcactggcatccatactacagtcaacccctacatgcgagattgctattagctctaaccggtatccatggtggtacagataagactaaagtgaaaacgcaccttgaaatcttctcaccctcacattttcgtaatgacctaacgcccgaggcagtaattcgtggcattcaatccctaaagcgtaaagggcaagaaagcttaacacgaaactatctacggtttgtaggtttccaagacgtagaaatcgaaaggatcttacggaataaggaaaatattcacttatacgaggatctggacgatgcgacagagtattcttcattaatggacatagctaagtcatgttcaacgcaagttgttaaagatataattagccgtacatcaggagaagctttcgtcacactacaatcgatggatacggacgctaagaatgtagtgataacgcagtatatctcgttattatgcgaagaattgaatgtagcgtgtacgatacctagactggagggtcaagcacgcaatttcatccgcatacctattatcgatgtgagtgttgagagtcagtgagccgttagatgaaacatca

SEQ ID NO: 224 - DNA, 4289 bp, Unknown
  derived from dsRNAs of unknown virus
gaaataaaaggtcgctccgtgatatccacctctgaaggacattgagcgatcttgagtagtcgccccttaggtgcccattattgagcagctatcatggacgcaatcacctattacacagatgttggaatgaaaaccaaccacgaacattgcaagtgcatacacggtagatctattaccctcctcaagactgatgaggcccccgaccctccttccggatcaatcgtcgttgggcttctcagtccagaggaggcgaaatggaaagatgagaatcagattcctcattatcccgacttcgagagtactccggctcatgccaaagtggcagaggccgacgctgctgaattggatccggccaccccagatcatccagcctccctaccaccaaaactggaaggtaaagagattgaagactcccgaggtggcgagactacctctcactcaacagacaccaagaacttggaatccactgaagatcataaggaggtcccgaaaactcctagccttagtgaagaccaattcatcaaggatgttttacgctcgctatcaggcaaaggcaactttaattatgccaaacttccctccagaactagcgcgtacatgactgatgcctctgacgaagttaaagagttagtacttgaggtgatttcgctaccggtttcatgtgacgatgctgatcttacaccagcccctcgtcacgtcatcagatctagtctgatgcaggctgatatcgtggcccctcagtcactcgagcgtgtggtgctctgccccggttgctgtgtgacttctgtttggacagcgcaagaggtgggttcatctcaccagagtagcgagtaccgaaaatgttcactgtgtcagcatgacattaaacgtccaacatccctgtccgctgtaaaaaggaaagcagggggggccgtcatctcagtcactcctggaagtatcgaagggtgcactaaggaagtagtggacgccctcaaggctggggttgaagctcgatcacttggacttcgtgacgtatatgtctacatgatcgctcacttgaatcccaccgactactccttctcccgtcgaaattatgatggtccagacattcgtcaagactacctgagtgtcgattctgacgactatgacttgttgtcaatgctaatcacccacattgtcgcatgcaaaactgacgaggaatttgtctcatcaagtctaaaactacacgatggcactttgacgatgttggagcttttcagagatcatgccacggccaaaggcgtgtggagagcttttcgtgaaacattctgggacaaacatgatggggattcgaagagacgaaaggtgctcccaagcttggttaatgaagagtatcacttggttgtatgcactacaaaggacacttcccatttaatgactaaagccttgtggtatgattactccaagcggctgctcgattggcgtgacccgttcaacgggagacctttcgctgacaccgctacaactagtagttgtggaacaatctctgtgaggtacgaagtcaccaccaaaagaagacaggatcctaaatttctcgatccgagaggtatcgccggagccatccccgccctcgtctctttcttcggtcaagatgactttgaagctttgaacgacattgcctattggccttcagactttcatgtcatggacgctaccaccagcgacgttcccaactttcgccttgccaacgtcatgcagactaagcactccattgctgatgtgcattcttgcttacagaaaatttacactcaaggagcggggcttcgtgaaattctcgaagacttgcctaggctcagaaccacctgcctccctccaggtcaccatgatgctccgttcaacgagctaattggtatggctttcagcatgcttgttagaggtcaggaattcaccccccaagatgagtggagagccctgcatgcttccatcgtcagatgcatggtacacactaatgagctgttcaaagtgaaggcgtccgatatgatgacctctgatgacggaaaaagccgcttcaccttcagccaaactgagaatctcagtgagggtagagcaggtgaacttgtggagaccttcttcaccttgggaaaagtgctattttgcaaggtggctgttaagattcagtgtgaggaaggcgtggcgctacgccatctgtatactgagctattgttgctgtctcaagctgcggagcctggtgccgcttctgttctcggattgtttgaacaccttttccactattggcggctgcttctttacgtgatgaccgcccaagtgtattcggtgtcagtccgtgatttgacctggggtggggatactcacgccactaagcgaatgactcctgcctccttcttcaataacctgtcccatgtgactagtcaactacagctacaggttcccatgctcgtccaaccgaaccgatatgttccttctggtctcggagtacatggtgggacggctatcgtggacatcaaacccatcgatcttttgactactttgggcgtctatcgtttcactaacgcaacaagggccgcgatgctccccgatcgacctgaacagcctagttttggtgaacttttccaagagctaggattgactgttgtcgcttggactccgagagctttcctcaaccctcatatgaatcatatttttgaacgcaacaccaatgactatttcgagcaaaagaatgtcgacttcaccatggcctatgtgaaagtggggcagttcggtttgactgccatgaatcctggcgtttataatgtcacccaggttaacaataccatcggagaaatgagcccaacacacactcgcgtgagcgccattgacctcccttgtgacgatgtgaatgctgccgctggtcttacagtcaccaaacttcgtcttctcaagacgggtcaggagtacatcgcttaccgatctatcctattgatggttgtggaggcgcttgatgatgagagcaaaaacaatttcactgttgatgtcttaatcaagagagtaagacagctaatggatccattgattgcctccataaaaacaccacttgacctcaatcgcatggtcgctttgcatgagtgtttgctcatggcgaaatcccggactgatgacgattggggttcaacctcacgaaagagactcatggatgcattcgatttgcttccccaatttgcaacagatgcaccgattgtgaccgctccctccttggtaatcaagggcttggttcgcgcccgtatggggctaataaggtatgttcttcaacgacctgatagccccattctctggaacattggaagtgtcacactggtgtgtggtcagtcatcagttgaatctctcgccccacaagcccccatggatgtggatgattctggacatgtccgagccagtgtcattggcgcggggggcctgcggattcaaactcggccaaaactatgcgttacacttggcctgagcacaaacttcagcattgagaaccataacaagaagttggatgagatcaaactacacacccttatgggttcggtcccgcccgaattgtgccagtcagtgcgagtgagtgcttttcgtgtcatgtctaccatcatgctgagctccaatcggaaggtggaggaacaccaggctcctggtccttcggtgaatgatgtcgtcaattcgttgaatggcaccacttgggcggttgtaatcccagaggtactcatctctactgatgtgagcgtcaaaaaccacagtctttcctgtgtcgtacacgaacggagccaagagaataccactgatattcacctcgagagatccatgcgcactactatgaccgtgccaattttcaactctgatccctctattcgttatgcgaaattccaccccagcgtcactctttcaactttgataactgatgcggataaaagcgtactgtccctccctttggctcaatccatggtgggaattcggtgcgaaaacaaacaggagagtgacatactattcagtgagatcgagaatcaggaatctttcaatcctactacccgtaatcactactctatgtccatgtcgtccaccaccagccttggtatgactgccatctccggacgagaggtcaatgaggtggttaccaaacagcttttacctcttgcaactcctcaggtcgtatcgtacgcccaagccgtcgtttctcggactttcactgttcactcctctttttctgacaacattgctacttaggctaattccgtccttcattgaatagataatgtgaggggaagtacccgactgcgcctctatatcataaaaaactt

SEQ ID NO: 225 - DNA, 3624 bp, Unknown
  derived from dsRNAs of unknown virus
gaataacatagtaacaaaatgtcagaagctaaagaacaacaaccattgctaccacgacctcagaaggacgaaacggtggaccagtttatcaagaatgagctatcaaaggtacttgatgacggcagcccccaatatcccgatctcataaatctatcagcggataaggtttttgagaaaatggataatgacgctgcatatgcatcagtagttagtgagagtaattacattgatatgaaggccaagtttatgtcacaaaagagcgagggtgagcagggcggtgagggtgaaaaaccaaaagttgaagctgatgttgcccccaaaaaggaaactgtgtctgtagttcctgaagtaactgtcgatgcactgaaaaccgttgaggaagcgcagtttgtggagcctcttctaggagattcgcctgagcagccagccatctcaaccggcagacagcggtcgaagatttttgagccgacatatcggattgagacgagacagatataccataaggttgcatcgaaagccactggacctttcgttacatctgaaggaacacccttagatgatatcttatcggacgtatcgtcatatgatctcaccaaaagccggatgaacatgtatgcaagattcatttgccagttcgtcaccccgtgtgtggttcagccactctccaaggttgaggaggatgtgtatgtcccgatggacagtcacgccttgcagccaactacggccaagtcaaaatatcttttaactgtggctgaaagtggcaatctgatcaggccaatctacgatgtcgctaaacagattgatgccattgacccaagggctaatgattttgtggagcgtttcagtagaactgatgatgactactttaatactgagggcgccttcaatctgagtgcctaccccttcgctagcagaaatgctgcgggagccatgtaccaagaggcggaagctcacagtttccaatgctcaccacatcgctatgccgtgctaaaatgtggaatgggtgcttttaagtatctattccatacattagacgagctacggagtctagatgggtatagacgtgactctgctgccgagctcagcattagcagaaacgaacttggtgatatcgacactatcgacaatgacagcacaaaggtaactttgtatccacgcttcagcgtcggaagtgcgtatgacgaaattcaagttcagagagcggcgaatatgttcttcaggaatgaagtgaccaatcatctaggtgtcaatgagctgtatgaaggcgtaatggcgcgttcgcttgatagcgccagcgcatccttcacccatatcacgcccgggactgccaacttcacaataatgccatcacctgggcttacaaatcacagatctctatccgagatcgggtcgatcccaagctcagctggtgcagaaatgatgcgacagttaggtggtgtcttatgtggagggctaggtacacatctctccttcaacatggatccaaggcctgcatccgcccttgctacgcccttatgttgtgcagcgactatgctcttctttgataatgatatgcttgacacacacacattgcagaatttgatcgctggtatgctatcccctttctatgccgattctgagctaactgttcagaatcatgagatgggtggcgcccgtaacgatgagtacagagcagctccaggtgtcagaaccatcctaagtgcgtcccagattgcacagcgcatcgtcgctgccatccgtgacaaaaatgcacaggaggagattagaggactactcaaagcaaattacaatggaaattatggtccagttgggtctcaaagagctgtgaaaactcatataatcaaccgtctaaccgcgatcctccaactatacagtgcctcccgaatctttgttgatgtggagctgcaagataatttcagattattcaactctaatatatttggagaggtacccacggtcctatgtcctttccttcctaggggaaatgtgcagctggagcaatccatcctcttgggcacaggcgttcatagtacgagtggttacgtggcaggaggatatcagatgttccaaaatttattgtcatatgtcgaactccttgacttcacaatcacgaagactaagtctcaacctctaatggactccttcaaagcatccttcgataatgccggaggaaaccttcatttggcgaaatcccaagccgtatttacagatgcgctcttcaaatgcatttatgaaaagacagatatattgcccatggagaaaggacgactaccccgtctaggacaggaaggcgtgaaatccgtagtcttgccattagagggagcgctttccttcatgatccatggaatcggttccgctagtgtcaacgaagagtctaccttcatcccctttgaacgatcaaacattacgcaacttccatcaaagtaccccatgtacctatacctagagcgagccatcactcaagaactgcacgacaaagtgatacgcgttaacgctgagctaccaatactgttccatcgcacagacgagctggtagaggtagttaccaaatcgctaaagagaatatatgcttcattagatcccgataccgagaagcgagtaagtctaatgctacggcgtcccggcacgtacttagtacgtagccgagcgggagcacgcttctccatcccggctgaattaaagtatcctgaaactatactcaattcccaagcactttccgatgatgctagtggtcttggacgagttttcagcaggaatgcagctttccttgaaggcgacacgatcccaccccttgccggagagggagcggtatatgcctacactcccctatacaggaataacgttttcctacactgccttgaatacaagagtagtcggactaaggatatatacatctgcataaacggacttgacaagttctatttccgcgacggagcgtcaattacatacatgatgtacggagtcgatgtagacaaggtggtcatgggccagaacgccgtggatattaatgatatgcttgagaatagcgttcatactgccaactacacaccctctgtaggtagccttctagcaatggctcgtaggagaaatgcggaaaggggggaaggaatcgcttatattaaaattccacaggctaaagcatcatactcattacaggagctatcttcagatgcagcatatgtcaatgaatcctcagagataaaagtatctaccaaatcatacggagaattctttagatatgaggtagataacttcccactgtacttcagaaaatccatgcgagaatatagcgacctggatgataattccttcggaccatataacgaaacttggattggccatttaggcatgagtccttcccacatttccgacgagttgatcacaaccgagggtataaccgaagagcttaatgccaatgagatgttccaccccagaaagagagccttcaaactggtcgatggtagtggtttcgttcacagcacgaacatgacattcacatcgcgtgacaaggatgaatatgtaattaaggataaggtggacacttataatcctttcttgctctaccttcctcgtcggtaaacgcgcgattgaaaattttgtagatagaactatgcgaaaaacgtc

SEQ ID NO: 226 - DNA, 3520 bp, Unknown
  derived from dsRNAs of unknown virus
acccacctgtcgtccttagctctgaggatcacgggagggggcccttgaagacttgccagacttctgggtgactgtactattgaaattcatgctgatctgtatacctcagctctatgggatcttttgtggcttttattcctgccagctcgcaaccgatgaccttctaccgaacctctggactcaagttcgaggccttgaccgctatcgaaacgcttttgtacagatcagaaaagttttgctgaagcccttcagaaccttgaaaggtctggatggtcgagcgaaaactcttgctgaattctcgggtgtgcgagaagtaattcaactcatctatggtgcagtgatcggaagtgaaggtcgggaggcttctattgagtccatcttcttacgtccaggattaggagccttactctcgctctttgttgggattattaaagctatcagcccctccgaagcctggtccagggatgttcttgagagcctgaatgtcatgggtttcaagaggcaaactcccatgttttgggtaagccccttccctgtctgcgggtgtgggatcagagaatccaaggagggtgtgattgaagtcggctcttcctgcggcccagacttgactgctgaactgaggttcgcccgcctccccaacatgcacatatcacgttgcgttctatccctggtgcctgaaggtctccctccagaagaaggcgtgcccatattctacacccccgtggtgggacaggataatctggtgatcactggcgacaatccggaggaggattggggggttttatactcttcaaaccccactaccgggttgtcggctgtcgaccgtggcctgctcttccttatgactatgtttaatataaggcctcatggttttctcatccctctggacctcatcaacgtggcgtcggccctcgcccctactgaagcttgggttctgaaggattattcaactggagatccatcttcatggcagacttatacactcctgaatgcttaccaacttcgtaattgtcgtggagatcttgtcatctccagaagtaatggccgctacgagttggttgatgcgtctgtttaccccagtccccaaggagtaagccccgctttcgctttcttcgatgaaactctgaaagagattccgacctatcttaaccgctcttcagccggcgtcgcagtcagcaataaagacgggccctgccccttccgcgttagcccctcgctactgactaaaccctgccattccaaaagtgatactctttccacttttgcaaagcttgatcgaccttccaaggacgacatcgtcaccctgttaactgctctcgggagaagttcttgtgaagtgtgctcgtgcaatggggattcatgtcctgtattttgtagcctgaacctaacatgtcagctcttcctcgatgaatcccttgtttggcgggattattcgactgagtcagtttctattgacttctatggtttggacaccagtctgctcaaagatgggagtggaatcagccagacttcgattgagcgcctagtcctgaaacgcgccaatggcctcctcatgaggttgagtcacttccgagctcaactggatagtcagagtccaccgcactccttcgctaccgtgaggcgagtgtcattccgcgactctgcttacatggtcctgccatccatcaagagccaaatcatcactaaggatggtacctggccaatgactcggtcaggactggttttcataatggtagatgatgggaaatcgacccgttacaccccttctcgttttgggcatgtgtatcctctaccccaagtgattgtgctcaaggatctagatttagtcgcctactgcccagatggttcaggattgcagttcggacaggtagtgaggccagactatcagggcaagatgtggatacccttcagggggatgaacgacgaagatgtacttcatcagcaaaccgtcaatgggagggttgtacccatcactcaaaacctaataccgtcttggattgcctatgcggttaagaacgatccagaattccatcaagctccaaaccagagcttggatcgcatggctgatcaactttattttggcatgtccagtttctgggtccactttcgcctcggagatctcggacgagtacgaggattccgggtcagtcaatcacctcattacgcgtttgtctctggtccggttagacgggccaatggacgcgagttgcctgaactttttgtcaggtacccttatgacgagaaagttcgggtcgatttcaaccagccgacattggtcgtgagaccgatgtgttctattccaaccgcagtcgctaaccagctagcacttagcctgcgtcgtggcgggctaacttttcgatgcccttgcacctttcactcccagactaagttcatcgatgtcaccacggacgaagatgagactatcacgggcaagatcaagaagtggcacgagtcgaatggaatcctaaattgcgatcactataggtacctcggtggaattaggactgacaccttcggcagtcttgaagtatcggagtttcgggaaaatgattccttgagacaattatgtcagactttcagactgttcatcaaagcaaatggctcatttgcagtcagattaaggcagaatattggggctcattggatggctcttgctcctctcaacactgaagtcgatgaggcctctcaaaacgtgttatatgtgcaacacaatccgaccagagcttctccggcgttccaacgtgtgtcccaaaatgacaggttgtgcataaccaaattgttcgcgccgattacgaatgggggatccaacaccatcatgaacctggagaacctgactgtgcacattggacctctcttgactgaagcactgtggtatctccttttatcggggagtgtcctcaacaccctcattaatgggagagagtacagcgatgaggtgaaaaccgctatcgtgtgcatcttcgggcgagtgataactgtcagtgctactgtcagggaccaatattccactttattggatttcatgaacaacttctctcgaggagtgggggtcgccggtctcgattatatgtcgggccataccaatactcaaatctgtcttgctactgcgagggatgatcagaacgggtgtgacttgcggtccccgcttccatcagcggtgctctttcccttctctgaagaacacactaccccgtttttcagcaccctccgtcgggggatcaaaaaggggccttggaaagacaacgcttctgactctaagttcaatgacttggtcaggttctggagtcatgcctctatggccattccttcattccggggtatgctgaataactctggtttttctatgtttttcgatcagagtctcaagggattcacatccagcgcgggtggcgatctactgtcgggtgctaatgctatttttggtccagtgtacgagcggtaaacaaatacgtatgatttctctaaaacattcggagggtatagtcgtgaagcaatgcttcttcatcattcactaaaactt

SEQ ID NO: 227 - DNA, 3459 bp, Unknown
  derived from dsRNAs of unknown virus
gaatattattggaagaatcttaagtacagatgtcgcaaaccgacgagcaatataaaggtaaactaccacgcccggcaaaaactcaaactatcaaagagtttgaagatgaagaaataaaaccagatcctgagtacactgaatttaactcggttgcagagatcctggctaaacctgaatactttaagcttataattgagcagcccgaattccaagccatgcttaagcgcgaaggtatacccgatcccctagccactaaggccgagggagaagacgctggcaaagtgaagaaagaacctgttaaggatgagcagaaggagaagaaagtggaatcaaatcctgatgagcaaaaggcagacgctggagaagatgaaccaaaaacgtcaattgacgtcgttatggttccatccttagaagagattgcgcccatctccgaggactcggtcgagcctgagaagcctgtggaatcgacgttcgagccggcataccgtcgtgtgagccacaaaatttcaactcctgttgaaatcgatgtgacacacgatatggcgactttgaagagggccggaatcgaagatttactcaccgacttcagtggggataggaagacgaagaggggagagaagtttcacaagttccttcagcaattccgacccctggcggtagtcgaaccgttgtcgtatgatggtgagtcgggctccgtgcaatacggtaaccatgcatacgtcttcaacgaagccgtagccggtagcagtgcgcgtactcacgaatacgagctgaagcggatcaggccaaaagtagtgtcgaaccagttgaccgcagatggcgagcgacgcgacttgatcgctcatgggaataaagcggttgcgttaacggaggaagtcgacgaggctaataagcagatggtcgacctagcccttgaattgcgtaggcccggttctagcattaagggagcggatgtgatcatcaacccgttccgtattccgttactgttacgggatatggtggcgtacaacgccatgaccctaacgtacgctggttgggtagccattcacgaaccgtatctcaatcttgccatgttaaactatgtgcgtgataagaatgcgcaggagcgtgacgtggtcactaacacgcatatgaagcgatctatgtatgatcgtttcgtcattgaaggagcgactggcagcaacagccaggattactactacaacgtactcccaagcatggctaactatcaagtgtgtgagggagtgctgaacagatccatggctaagtcgatggaggcgatgtccactctctcatcttcatcgcgttcaatcagcgctaacctaaccaacaggcaggcatcacagatgctcctaggcctaacatcgatccagcctagcgacggtgttaacttttctaggcatctaggagctttcctgcttggcgggaaaaggaggacacttgaagttgatatcgatgatggcgcttcgaagtcgcccatgattaacgctatgtgctcgatggcttcgctggctctgatcgatccgaagttcatggacccacgaaccaggagacaattgcttatgaacactctgttaccattctacgacgagtttaaggttcagcgccagaacttggaagagcagatggacgttaaccaaatcgctcaaatgatcgaggatggcgtgtacaacctgccgagggtcactaagctggttgacacaggtggcaaaggcttcgtgcgtcagcgagagatcagaacgattctaacgaacctgtacgctaggcttggcaacgttaagtatgacaggttgaacgtgactggtcgtctgtacagcgcacctaccgaagcgccgttcatccctttcactccgcgcggagacattatggacatcgtcctgttcgggactcgtacggatggcttcgaatcaagaatgcatgaaattgcgtcgtataagcccggcaattaggatctgccgcatgattgaggactacgctgaagttctcggcaagctgaggcagtatgatggaattggcatggctgtgtccgaagcgctgaagactaagactcatatggccaagtccatggccattttcactgactccttcgtacgtggttcgacgcatgttgagcttctggctccggatgactcaggggcgaacgccagatctatcgatacagtcatgctcccctttgacggcgctttgtctttcatcctttacggtatcggatcgtcggagatctctgacacgtctgatgcattcattaggttcaaagcgaaggcgtcgcccactctcccttctctgtatccggtgtacctgtacatggaacgtgctatcgtccaacaggcgtatgctgcgttctctacggaaccggaaccgtatcttattacgcatagagaggaagtaatcgacttgtgccttgatgctctaaaagtgtacttcgtcagtatcgacccggattcccgcgcccgtattggtcacttgttcgacgactccgagacattggatgccacgcgccagctagacctgcctagcgctctggtttcgaacatctttaccgatacggaattcaaacctgcgcttggtcgtaaaggacaggagagcctccctggttccctactcagcaacgctgacattgaggaggccaaccctttgatcaacccgtacgttggttctcttcaggctgttgacaggaccgtcaaacggatgttcatcgacttcgacccgatatccccagaagttttagagacgtactccactgggagcgtgctgctgtacacaggtgagcgagatgtggctgactacgtttcgttgtcgactgtcattgccaactcaaggtacgtcgactcggaaacgttatcaattgattccgttaaaagcttagctaaagcttatttacgtgggatcgacagaacggcgaagggtgtgtttatcgataaaatccatacttctttcaagtttgtggaacacaagggactgagtgacatagtcgttgagacacctacgatcaaaattgacaggaaccctcggtacctcgatacgcaatttgaagtgagtgaaatcagcatttactatcacaggcttactgatcgtcagggacagttaagtgagggcgttatcgagcgcgagttagattaccttcgcgggttcatgacgtatgtgtccgtcgatagtgctgacattcaacgatgcttgattaactttgatcatgctgatccaatgaacccttcaatctaccgtattgaaggcgacgacgctaacattgaggtggttgacgagaaatctattgctgcaattaaaatacgtgatggccgtggtattacctacgctggtcgtgtgacactgtctactagagagtctgaagaaatcagcttaaccaaggaactgaactcgaaagagcgatttttccttgaaggctaataacatgggtatggactacgtgtaataagattctaaacggaaccaatatgaaacatc

SEQ ID NO: 228 - DNA, 3200 bp, Unknown
  derived from dsRNAs of unknown virus
gaagtctattgacacacacttacacatgtctagtgatcgagtaatcgttgtgaagcgggaaggcgagtcgcgcgaagatgcgctggctcgcgcggcacgtgagcacagggattcgcccgaccagcagctttggtacgtcgaggtcgaaggcgacgaacccgtggatagcggtaagatcgtcgccgactacaccgcggttgctgaggcaccgagcggcgtagcgcctgacggtagcgctgcggttgttgaggtagtagaggctgcgccggcgacggacgacggcgccggaacggcgcgttcgggagcggtcggtaaggccagcggtctgcgcggcgtcaccaagctcccgggcgaatggcgtcgcgaggagatcgtcggcctcaagcccctatcatttgtgcagattcatcaaccgaggtcgctggaaggtgaggtcacgagcacgttcgtcgtcccagaagatgggatgctcgagctcggatctctccaagtgacgggtcagcagaaagtgaccgtagacgaaatcgtcaagcggagccgccaggatgtgcttggggacgtcgaactcgcgcggttcgtcaatgggctcatcgtcgctgcgaatccggtgaaactacccgaacctaacgccgatcgagcggagacttggaatttacgtgagtggagcgtgttgccgcaagagttacctctaggtatgtcccggcttggtcggaccatggccgcgatacgcgacgaggatatcccttacaccggcgatgagatgccacggctgcgtggagaccccattgtcgccaacgctagcgacgcgaatgacagcgacgacggttcggacgatgacgacagcgatgatggcgacggcggggccgaccttccgacgtgcctgtctggattcaacccgaagcccatgttcacaacgcgccagtcgaccgcggaccgtatagccgcacacggccgcgcgtgggatcacacgtgggtcgggggagaagatgtcgcggcgtataaccgagatcgtttccgtgttatcgccccacagccctaccaacgcgatcggacgttggaggacggagtgcgcgaaatctaccgcatgcctcggatgttcgaaggtgacgggctgttggacttaggtaagttcacgcacattcaagaggtgctggcctactcaaagtcgtttgggccgtcgttcggcgtctcgctctatgcgggctatccccttccaaaaagcgtgagcacaaagtggcgccaggtccatgcggccttcgccgcgaccagcgctgcccccgcggccgagggactaacgaacttagtgcaagccttactctgtatgcaggattgcgcgctgaccacgcccccggtgctaaacccggacgcggttatgaccctgcgcgcatgtttacttgccgtctttagtccgatgtcgatgtatacggacggcggcgccaacgtagcgaacacgatcgctgcggggttcggtgctacgcgagatgaccagattgcacacatggcgcgtaatggacagcggaccctactggcaagactgttcagacgaagggggaaagaggtcgctgacctactcgtccgcctattcgacgagagcgagcgctttacgcagtatcggctacaggatacagggacgaacaacttccggcgtgagcctctcacgttctggaagatcccccaagccgccgagaatctattgttcctgaacggtcttgacgagtcagttacgggcatagatatgggcatagccacagcgatggcgcgccccttccaggatctgtggtcggggcatgtcgctccgctcatcgcgagcctcatcgagggggtcaacgggaaagtgcccagcgaatggtttgaacagtcgttcagtgaatcgctcggtatgtctatgttgtacgctgtgggaaaggcgcgcatgcatggcgcctttcccgtactgccgatgaagcgtaatgcgtacaaggaaacggcgccgcgcgagctggtcacgatgtcgtgggatttcggattatcgctcatactgttcggaattaacgaagtcgtcgtcgatgggagagtgactaatgctctgcgcccgatggtgcccgtgtcctaccaagtgtacgcagatagtgtcggcgttggcccgcttgctgtgcagtacatgataaccatactcgtatgggtgtttgtgaatttcggctttgacgagaaggaacgtgtgctgcgcaagcgtagcactctgatggcgttggcgcgtactctgcatgggcacatcttcgttaacgcatcgagtgacgcgatggatgaaatcgcgttgtcggtatataacgaaatgttacgcatcgtatcgccctatcttggggcgaacatggcgccgaacgcccgccaagcagcaagcatgcgcctccaaaatgagatggggaaaaggtacacgctgctggacctcagtctgtggctgggcgaggacgagaagaagtcttactacgtcttcacggacgaaattatgtatcgactcccgatgctcatgacccccgtgccaatcaggtatggcctagccaaccgaatgcagcaggccgaactgtacctcccaaggccaatcgagactgacggcgaacggtcgcgagtactggacgtctcggtcaaccaggcgatcgagtggaacgcgggggatgtgtcccaacttgtcggtatggccgcggatccattccatgcgcgtccggtagcgactacggctgccgtgtcgctaagccggcggactttctggtcggtcgagcgcgcacccgagggactcgggcgcgggggatcgcgtattaccggtcaggacatttccattaagatgtcgaattccaggggatacgagctgacggacgggaaagaggtcctctattaccagcccacagatgaaataattaccggtgcgtctgtgttggcgtcggctgatgtcttccctttcctgtacgcgactaccaatccggaccaacgagccctgtttatcgtcatgccgcagaacggcgatgtggacggcgatggcgaggtaaatacgggtctctacgagtacgaaggcgagcagcaggattaccagcttgtaacgctgaatatgcaagaagttcgcgtgaagccggtggagacgtacgaaccgcttccagtggacagctggtcactagtgtctgtgtagaaatgagtcgagggggctttcacagtgtgcaacggagtcaaagatc

SEQ ID NO: 229 - DNA, 3031 bp, Unknown
  derived from dsRNAs of unknown virus
gggatttttagtcgtatcgcgcattgcaattagtgttatgccgtcgagacgtacaaagcgtaaatctatagctcataaggaaagccaggaggctgttgaatccaaggatggagcaggaaaggttgcagaagtgccaggtggagggagtggagccaaagccaaacccgtcggcgacggaaagagtattaacattgctgcggctgcccattcggtgcggtttccggcaaaggaggtcgatgtggagatggaaaaggaacctgttccaaaagtaccccctatcgagcaaggagctagaggaccaacagctgaaggattccgcacaggtatagcaaccaggagggggctggacaacatggctaacaccaaggctgatgatgatgctcaaccaaatacctctaatctgcaaataatgatcgactccacatacaaggaacgtatccagcagttgtcacacaatcgtgccttactggaaaaggacgagataggacctgaggtgttgattaaggctaattacgtttcttccactctcgaagagttagaaacattgtcagacgctgtgatagaggcttcggtttcggagcccacaaccgtgacttttgataaacatatcacctataataagttatcactacctgcacctaatctcgatttcttggtgagtgaagaccatgcctctatcatcgtgaaggaaacgctccctcacatcactgttgatatgaacgttgatcttgctatgcagattagagccgttgctacacaacttgtggatcaaacattgctgacgccttgtgtgtgggcacctgccattgagagcgagataccttttgagacatctgacgtgttggtggctaatgagggagtcagcatcgagagtataattagagtggaacgttctagacgcagggcgactggtgatggtggcagtctcatgggcgaagagttcatcaggtacaagacgacgccacacatattgagccaccaagatggcagttctaccaccattagaattgatggtttgataaggaatgatatgcacaataggattacggagcaatggatgccaggtgtgaagaatttggctgaagttcaagctctgctactctctaaggtgcctgctgggtatagattccctactctcaccagtcaggagcgtaagtggtattatacctaccatgacgatcatccagtcagtataggtgcaatatttgatgctctgcctagcgagtgtagtgaatattataggaatgtttacttacaggcacttagcggtctaaggatggtcgtcaacaacgtacaacccatggcacgtatgtttagtactacagcaggtattagtatgacgtctactacttcgggatccatgttgacaacggctctgaccgaaaagcaagatgtgcttggcgtcttacagacattaatgatgtgttcagtcttcaacaattataggatcacattccctgaacccagaactacaaccgtcgttgaggcagtggcagcttgtttggtcttactcacattcagcaccaacagcatagatgatcaaacacataggatcctgatcggacacattcacagctttatagttggtagtgtgaatagaaggttacctatgcgtcagatggtaaacgatctcgagaataggcgttggccaatcatacatccaaggccacctttcgagttcgttgctgagggtatatctccaatgttggatgataacaatgaggctgtgatcaacgctgtgtttaatctcgacccttctaatgctaggtgtgacgtggaggaactggtgcatatggtctataatgtgagatctgccgactttgcagagtcagctaagttcaagatagccttagcgcaataccttacactgtattgctacgcgatggctgacaccagtctgagtatgcatcgttgggccattgactttaggctcagcgtgccaaccgagcttagggaaaagtttagatcagaacttgatccagtcatgatatcacccaagaagatgttaagcttcacctctcaacttagcgagctcgtttatgatgataccagcacactggacctaactgagtttgctaatgctaggaatcatgagtttcttgagctggacaaggacattcagcagacgttatgtgtcatacaagcaacagagctagtcactagcaacgtcaggacaagtactacaaagaagctaatggctgtagatcgtttcatcagtacatatatgccaaaattatctaatgccatgaagaacatccttaccttggcctctcattccactgacatcaaatctggatacaaggcgcttgtgagagccttggctggaatgagcggtccaaatttagagttggagctacgtaagaaccccatgaaccgcatccatcaagagattgttgctaacgtcctcgacaaccttgaggcatatggtgtgactgaacatgtgctgatttgcagacagggaaaagccaacaggttaccagctgggctatttgctactgacatcaatcacctgctatacaaatcaccatttttgtccaggattccagaggatatagatggaacgcccttacacagacttcgctattctgactgcttgatacatgggtttacaactctggccaaggagggtgctttcatacttgatgcacggtgtaattttgaatatgatataatgacagaacattcagctgtaactagtcatgatcataacattgaggctcaatcctcaggttttaaactaatgaggttgaagtggagcattggcatgtccagtataaaccctgatgagaacagagacaacattagcatgatgaatagtaatctattcgcttatgtgcttaagcctcaaaacctgacaccatgggatgatatacttgctcttgaagctactacgcgtcatatgcctagtgaggtcgtcccctatggtaagcctttgaccgctacattaatcacataatgataaggcgtacacgtttgctttgcgtgaggttgcgttagatcgtggtgactaacgcttccagattatataaca

SEQ ID NO: 230 - DNA, 2775 bp, Unknown
  derived from dsRNAs of unknown virus
gggattaaaaattaactaaagtcgtcgcgatggcttcgcttttggatagtacatctattgttcaacaaacattaactgagttgcgtgcattaacttttaagataagcaacaagaagggtaagtataagaactatgaaggtagagattatgtttccaatgctgtatattatgcattaggagacggttaccaggcagcaatggagggacaggctgtacacattaaagatgctgaagtattcagacgttttcaacagttgggatttagagtggatgagtatggaactggtttcacggctgcccttaggggtatgctccctgatctaattagcaacaaaggcatcaaggagatacaaggcgttgacactcagaccatgcgtatactaagtatttatgatgtgaatgatgttagtcttaaggatatgtacgttcctgtaacgggtcttaacttcattgatgatttcaggaagcactgtgaagaaaggttgaatatgccttgggccagatcactttatgtattactgcagaggttagctgtttattataaggactttgagcatacgttcgaagacatagttggtattaggccaatgagtttacccaactttgaggaaagctctcttgggtttagtagactaaggatagctaaagtagaacctacctcatatgtgttgtttggtccacctggtatagggaaatcaaccatagttaaggaaactggagggttagatctagagcagggtaaaccagtggaggacgcttatcgccgtaagtatctcactgttggtgcggccggttatcagaccaaggattttgactcaactagattcactaccttgtttttatacactgatcagttgtcgtatgagaagaggagagctcttcgtgatattgaacaacctgaaaaggctgatcaacagcgcatgtacgtgagtcaatttatgcagggtgatggatatgaccattacgtatactcagacactcgtagtgtaactaagctgttatcgagcacacaagttaaagatctagcattagagtatgcatatcctgtaagagcaccagctttaggttcagtcttgggacacggagttaagaagaacacaatgtctacggtggggttagtttgcaagcatgacatgctcataactataggggatagtccaggaccacattacaacaactaccctcatgttgtggacaacacctactcctgggatccattgcctcctaagtataggaccaagcatgtaatggatatattcacgtatgatgatgtacccatgctagtatctctgattgagaggaattatgataagaagatactcttaaggatggatataagagctgatagaccggaccagcctgatgtgaatagcagtcaacggagtgttggagtgaataggggagtatctcaaaactttgagaccaatgtgcataatgataatttgttaatgtctcatatatctaggacagtgtgtaaatatgacaaccttagcttttctgttaaattgagaccttcatactcttctgattactctgaacacgtcctcgactatggttgtgatgttcttttgttgcctttgccatacacagctcccaccaccatggagatgaatgtagtcaagttacggtctgggattgtcagaaattcagggctcattcgcaatatatcatataagtctttgatagatgcccaacctgagtttatcgctcttaagaagttgtgtgggcctttgtacacgcacttcctaattgatgctcattactcattgatgatagatgaggcagaatttaagcctgttgataacagttttgctagcttctctatgtctaacatcaacaaccctagtccttatgacatttcaatgccacacaatttcctatatacgtacccatatgacgtaataggatcagttgatcatagctttgtcacaaggaatagaaggtatagagaccacacagtcagtcttgagttcgagatatataacgagcgtttgcacgtcacgcccattaatgctattgcagggggcagaaacgctggagtccatggacgtgatgtgacaaccgtcatcatatctgacttccctgttactagcttcaaccagcctgagggaatcttttctacacaggtagttaagttagtctccgccattatgaagaagaagttccctaggtggcatgacactgataattcaataaggaacattgctctagagaacgtttccaagaggtaccagaacatgattctccgtattggtgggaccgcagctttgcataactccaatataatgacatcttcgggacacgttcagtatatcttgcttggttgtctcatgggcataccttacggattctacaagtatttgagggagatagaaataaacatccagaatgaaagtgttggatatgaaagaaagtctggtagtcgtgtatggcatggttatttgagtcatctctgtggagtagaggctgctagaataaccgctatcaagctgttcagtctaactactcatcagatgaatgtgtataacaacgcttgcactatattctctggtcgtatagcagcatacgcaaatgaatatgataggcaatatgtcaatgttgacgagattgatactatccattaaagtgattgcgtcgcgagggtctgaacacgcagttcagactggggtatgtcgtccttaaggcgggggctaggagcgctccgcgttttggataagagttgcctgaatgggcttctcatggtaccctttccagtagcgactgttaatgataaca

SEQ ID NO: 231 - DNA, 2708 bp, Unknown
  derived from dsRNAs of unknown virus
ataaatatcgtaaaggaaacatggctagtacaactagacttgtggatgaccaaaagcagctagaacaagaggttaaagatgatgctcgaattctcgcaaatgcgcgagggatcaacatcgctcctgtaaccaatgactctgcgattggagggcaagaaatcagaaacatcggtccaaatgaacaagcaacaatcaatgcattgaacagcgccatcaagaaaattgacgcactaagtaccaccatcagtaaaactgaaagattagatgacgcccagatactcagtccaaatacgtattcccagctgcttgaggatatctactctccagaagaagatgtgtatgtagtgctacccaaacatgccttccctgacataaaaggtgtcattgatcgtagagatgcatcgcctaccaacttcacattctcgatcgcttctcaactcatggtgcaactgtcagctacgacacacaccaagatctacactgactactcaaagatcacagctagtgcgctgggaccggaaacctccactgaaggtataccgcttgttagttttattgataaattcgcactcactgacactgagacggcgagactggcagtgatccaagattccatggtgatacaaaaaagtgaatgtacagttggcaatgcagaacagggagttagcactattggcgtaaagcgtgtaccattcattggttccggatttcaacaacagatggacgaactgctttggggatacagcaccaaatatttgaccaccaaggaacagagacggcagaggatagttcagatggtaaatgatagaaggatcatgatacagaatctgacattagcagagaaaccacaggtgatgagacacgtatcaacggaaatagacaatggcttgttcctgaagatgtcaccggtggcccaactatacatttatcacctcaatagagctttccttgatgcagtaggattcacaccactggctgagaaacaacaacagttacaactgcagttaaaaacaaacatcctgacagccaatctcatcagatctgccatcaacggaatggacacagagtcaaacatggaaatagctatcaagatgatgcaagccgctcagttgcataatgcgccaattgaagtagctttcccaatgcatgtctctttgagtcctgaaatcatcgtccagtgtttcatcatttggatgtccattcccgaacagttgttaagtgacagatccaacttcaccattgcagcagtgatctgggcaggattttccactgatgagtcttacgctgacatcatgaggagaagcgctcgcgcttctgacaggcaaaactatgacatcatcaaagccgctctctccagtagaaggttcaaattaccacgtgcatccgcgatcttggttgatgagaatgagccagtagttcgtcgctatcagatcggtagagtatacgcgccctttcctgtcgaccgctatggtagtccagtgtatagcaactgtactaaggtagagttggcatctgactacaatgctgaggggttcaccatcaggaaggatgactttagagcactgcaggcaatactcaggattgatgaagacagagccgctgacatgtttgccactctacgtgtaatggtatcatccattcccgctgtgtggtatgacgctgatgtagtacacttcccgcatgtcaccgtagagttggaaccactcgctgcatatggattgacgggagcgtacccacgcaccaatcattctgtaagcaccattgtcaagacagtcaacaatatcagtgctacgtacagtaccatcgcccagatgctctccaccatcgatctggatcccactcgctacggcacttctgagttgattgagagattcaaaataggatgggagaatgttgagtctattcttcagatggaagggaatgattttgtcaagaccatcatgtatgcgtatgaagacaacttcccaaagaaggacttctacatgatgttgaagcagattgctagtgacggacagggtgctcatccaatagcagcagcaatcgatgagttgcgcacgattgtgtacagggaaccagaacgatttagatacatagactcagtcatgctcactcacaacccggacgtagacgttgggtataacaaattctttcacttgcaccccatcgtatcaaatcagccatctaacaccatcaagaatgctcaactatggaatgaaatgagactggaactacagctagaatatttgaacgcaggtcctgtgagaatcgtcggcccgttccatgtcacttacaatttcctgtctgaggaagaagatctgcccgctactaatcatctgacaatgaaggagaacatggtactgaatgatcatttggcatttaactttgtcaagagggagagacgcaacaacaacaagagagtggaatcttttaggtatagagtatctgacatgtatgttgcagtccggatctccagattcaaggttgaagttcttcgtgacctacatgactttatgagatggcgtacctacctcgatacctcaaagagtccactagcaacatctcctattcgcgtcgtggaatatgtgagataggatgtgagtggcttcacttcctattgatcatagattaacttgttgaagatcactataggtcgagaattaatagttgtattggccttcctacctttcgctagggtgatgatcaacgat

SEQ ID NO: 232 - DNA, 2397 bp, Unknown
  derived from dsRNAs of unknown virus
gttaaataaataaatagaaataaattcacaatatcaactgccaaaggaggctttatgataaattttatactactgtcaagtttggcagctagtcctaacttgccactgactgacatgttaattagaggcaacagtgtctcaaacacgtttggaatggtacgtaactcaggaaaaagagcccatcagggttgggatctttcagcacgagtcggtcaaccagtgtacgctatcgccccgttcaacactacatcttcaggttaccatgctgactacggctactggatacagtacacttcgactgtttctggctatatatactttaatgctcatctatccaagtttctcgacttaccagatggagggaaagcaggcgatgtaattggatattgcggtaattctggtaatgctagaaacacagatactcacttacattttgagatgcgtgaggtaagtaatcctggtttaggattgtctggtagagtgagccccgctaaaacgttcggttcttggacgttgtatttaactaaccccgagggaaagtagtgatgactaatttaacacacccagatcacgaactcagtgcccacatcaatgtagagcactaccaggcgcatgaagaagagatgcgcatgttacgtcgtaaggaagaggcctctcgaaaactgtcaactaaggtcactgacgatagtataactactatctttgatggtacggttgtcatgaatgacgggtctgaagtgagagtccaaggtacaaagcttctgttgtcaggctcccttcatttcattctggtaagtggtaaaacccagcccattcactctagatttattagggaaatcctaatacatctataacaggagtaagagtctatgacccattctaatttcggaaaagaagcccgcattgaaccgtttcgcatagcccagacggactccattaccttaaccgatgaagttcgtggccgcctatcccaaatagttcactcagttgacacaggtagcgacgatgttttaagatctccttttctgaaggatctgaatgacaaagaagctctgtcagtctttgataaagtgttcttagacaagattgagactttgccgcctgcttttcgtgatttagaactctctaaccgtgacaaatttggtcctagatctatcgcagttgattggtctaagaggagagccagtttaaaggagtacttcgaattcgaaagtcacaaagaagtacagaccatccctacaactggtggcagactcagacgtattagtttatctaatgctgtaaaagtcttgaagaatcaaacttcaagtggactacctaagctaaggaagaaggctgtcctaaaacagggaattttagctgaactacaggatgagttagaggctaaatacccttgtgtcctgtacacaagaactcaggaacgcgagaaaacccgtaacatttggggatatcccttcgcagatacccttaatgagatggtcatttcatctccccttactgattactataaggcacactctccttacagatcgtctttggtcggaccatcagcagtagatgatcgtttacaaactttattgaatcgacctggtaagaaggtttctattgacttcactgcttatgatgctcatatagatcctcagatacaagtagctgcacgcgagaaggcaaaatctcattttcaagaatcagagcatgcctttattgactctatatacgacagaatgagtactatagggatcgtcacacctgatggaatctactatggatctcacgctgtgccgagcggctcgcctcttaccaatatagttgattcagacgcacagtacatgattgctagaaatgttactatacctgagtctgaggcagatattcatggtgatgatggagcttataatagcgcgaatcctgatgagctcatctctaacttcgtcgaccatggtctattagtaaacgaagataaaactcacattagtgatgattacttcatctacttacagaactattactctatagagagtaatggagatgtacacggtaagtatcccatatatcgagcttatatgaggctacgcttcctggaacgttggactaactttgaggatgcaggaatgtcaggccaagactatttcggcataagagctatctctatactagagaatgttcgttaccaccctcttttcgaagagttagtcaaattcgtcgtgaatcacgataaatttggtctcgatgtgtctgagaaagggcttgttgactatgtcaacatggttaaggagtcaagtggaactcagggcattttgcttaaccagagaggtgatgacgtggaaggtatcagaaacttcgccacattcaaattggtaagtgaaatgagctaatacctcggaaccttcgggttcc

SEQ ID NO: 233 - DNA, 2369 bp, Unknown
  derived from dsRNAs of unknown virus
acttacagaattaggatcggagtacaatcctctggtgagcccgtgctgggcttgtttggccgacccattctcaaaatctaggcatttctcaaatgactctagttctgtggggggaaataagatgaatacaatactgaaaaatctaagtgaagttatacctgcgaccaaattaagtaccatgcgaaaaatatcggatttgcataagtacctacctctcaaggtagcaggagttgaattacgcctagattcgaatgaattgcgtggtaagactgccgcctcaagacagggtggttttcttacactcacgaacacgccgcaaatccaagagttagtcaaggagtacgatccccgcgatattcatgcttatgttgaaaaagaactgaatctagattatgaccccgaactccgagagtttgagggtgatctagagtcgaagctgctggccccacgtggaatgagaaacccatttcacctgttggagcaagctctgatcgctggaccaactggcgacagcatgaagggaaacccagaaccgttcgactgggatatcctttatgaatgcatcgatgatctggtggcgattattcgccaacggattggcaaacggaagcttacaccaaagcatctagtaccgtctaccccgagttccgttaaggatactctcagggttagtcacgtactacccaacagttttgccgaggacgttttcagcgacccggggatcacaggtaccgccaaaggtaagcatctgagacgcgccatcactggtgctgaacggtttctgaagcctaccgatagactaccattgtggccagccgtcgcctttgctcgaggcgatagggtgggcacttggcctttggttttagacactgaagaggccaggtccactatggtgcacgagatgaaagatcggttaatcgccggtcagtccttttatctccagttgttggacggtattttcactcagcgtttgagtgaagaaatggctgccgcaaacattcctgaaattgatatgagagaaccttggctattatctaactggtttcaagaaggaatgcggatcgtcggaagcgagcctaactgtaaaagtataggctccgacgaatcggcgtgggatcaacatttcacgccacagctttggtatgcaggttttgctgtgtataaggcactctttgctgatgacgccgacatcgtcgtcgcacggagcgatttgccactgatatgttctgagtctgacgcagaactgttcggtcggcttgctccaggtgctgatactgtcatgaacttgaccgctctcgatggggaagaagaacgcctaatccctgtcgaactagtaaagattagattgaaaacggatgatgtcctccggagagtctttgctggagcttctggtagcggtttcaggttcggcgagctcctcgtcgacggttttacacatgtagtaaacagtccccgtcacggtaacgtgcagttggggtggtccatgcgctctgggaactggatgacgttcttaatgaactctctaggcaattggataaagttggcctacatatcgaaagcatcacggaatgcagctctccgtgcccagtatgaacagatgttcggcgtcccctcaccccgactaaagctacgatggctcgtagttagaggagatgacgcaggacaggtctggcagtacttagatggatttgaacaatctatcgcaactaccttagccaactggctcacgttgcttggcggtagtgcgaaccccgacaaacaggatacttctgatgaattcggtcggtggagattgggctttgcccaacttttcacttcggaaaagtatcctcggggcgtttcgagtggtatacgtgctatcgcgcgtaccatatggaacgagagagatgaagttgtactggacgatccagactcaggtgaggatatgcgcccctatatccgcctgatgaacatgactgggaggctatcaaacctatggggcctgtgggatcgcgctgtgcatccccgggcagaagaaatcacgagtatcattcaggatttggactatcgtgacagaattctgcctcctctcaccgacgaagagagggagaaagcagctcgtgcatttgcgctacggcagttcagacgtggcacaatccgagcagagagtatcgacgaagtcgtacgaagcttctggaatacagacttggctgtctttacccagaaacgacgcgattctctcgaaaagttgaacggacaatggtctcccctagcgagaacgcccgacgcacgtgacgcgtggcgtactccgtagggaggtccttcagcgaaaataccagcacctagccagacccggaacccttgggggggggaccgggtcaggtgcacct

SEQ ID NO: 234 - DNA, 2225 bp, Unknown
  derived from dsRNAs of unknown virus
gggaaaagtttctctggtgaaaatatggaaacttgaccactgaccctcggctgcaaacccatggtcaggctggcgcggactcacctccccagaccaaccccagatagggcgccggcaccaatcaggagatcggaaacaatgaatgtatacgaaagtactgaaaaccaagtggtagcattagatctacccattgagtatggacatgtgtaccatgcagacgacaggagcgctgttgataaccgcggcctgtattttgtacggcagcaggtcttgctcaacctcggcgttgcggactatttgtctgtgccactgacggggtactcggagcagggtagcgactgttccgcgatgacggctggtgagccgttctcaagagtaacccaggcagcggtcggactccgcaacggacagacaatgctggagctagctttagatccagcggaccacgtctgtccaagccaagacgcacggtgggcccggcgtcctatgacggaaaatgaacgcaacgcgctgcgcgaagcgggcatggaccaagtgatggaagaacacttccctcacgcagtatacagcgagattgctaacgctgtgtacttcgatcaggacggcctaattcgtgtgtgttcacgggagtggagcaccacttctgtgctcccacctttcaggtgggtaacggaccgacatgtggaggtggaaacgcttgactcagaaggcgaaaccgtcaccttcgtttaaggaccgtaaagcacagaagcgccgtaagcagatgcgggcattaggccgcgatctgtgtccagtgtgcttcaagcgtggacgaaaagccaagttggtggccctgccagagggtatcaacgtaccgatttcggtcgggagtggcgacaagtccagaaccgggtggatcggttctggcgacctgccatcggaactgtcaatccgatgctgcacggaatgccgctggcataccggcgcacccgcagaccatgcggagtggagccgggaagtccagaagcgtgacttaccttacggtaagatggtcatggcgctcaagcgctatgtctgggagatgacgggttcaccgtacttccaacaccttacacctagcttctggaatggcccagactacgtcgcatcacagcgacgtaggatcacgtctgtacgcgatgacataatgttgtcggctgcaagcaggctggccaaggcggaacttgaccgtgtaattttgacggctatgcaaccagttgtgcagccgtctgcgccacgtgatgtgaagcgcaagctacgcgctctgatgagcgtagctcggcatgtagaccccgcaaaggtgtaccgtgtgaatgaagatctggaagcagaacacgctgtctggaaggaatcgcactggatatacatgcgggccctcgacgatgcgacttgggacaagtggaatgctatttgtgagcaggacgggtttatcgactcggacgcagtttacaacatgctccgcaggatcaggaagcagtgggcgctgaccgacccgaaggatatcgctatctctcgggataatatgaagctggatcttctgctcttcatgagtaggatattctcggctgatgagtataaatcggtgagcatagacatgctaaagcaacatcaccacagccaggtatggcgagcgtaccgtgaaggtgcgttggaacagttcgacattgccgacatcaaagcgatcaaggcagccatgacgagtgctcgtcgtggtaacaagaacaaggtccaagccgtaaagccgctgatcccgccagtagtaatgctggagtgggaggccgcagcccagtcgaaactcgacaaggttgcgatctgggatgctgagatggacaagctgatgcgtcgcttccgcgacggcaagaagttcgtcatgaatagcatgcctcaagcggtactagagtacctgtctatgttggacgacccgattagcggtgtagctaggacgttcctccacgcggagaactttcaacagttcagaacgcacgatcccgagtggatcggaggacctgtcatggcactgctgtccgattgggaagcgatccgagaggcgctactttggcaacgccacaagtcaggtcagttgaccggcctggaggcggaaatccacgactgtctgggttattacgccagacttgcagccagagctgcttagaccccctgggggggacgcaataccgcggtgcgcggggttttataaattcgcaccc

SEQ ID NO: 235 - DNA, 2183 bp, Unknown
  derived from dsRNAs of unknown virus
gataaattacagtatcacatatcctcagtgaaaacatggctttcagaactcgtctagcacttcgtggacccgatgatttacttggcagaggagtcctccgtcgtcaagattacggtaccacagcgcagataaatgaaggactcacggttttcgattctgatggaattgaacttgctacgaagctggatcaaactacccgtaatgcaaacatcacacgaaaagggttgaatactgcaattgctgacattgattctgaaattgaacatttgtctgaaaatctgtatgaagcagaaggcgagatcaatgaaacagagaagaatgtagttcgaaccgcgcagatggttggtcattttgaacgagcaatgcgtcgagacatcgccactattaatgagaacattctggccaattctgaacagattactcagataagaggtgatttgatagcattggttgaaaatgtacgtagcaacactgtgcaggatatcgtgactaccaccgcccaaattgctgagaatatcggtctagccgctggtgtgacaggagcaatggttccgttcaattttgtcacttcctctactgccgacgccacaaccgctgtcaccattgctactgacaccgtttccctagctacttcatcttataatctggttcaactacagaagatcttgaagcaagaatcatctctgaaggaattaatccctatctttgccaaagcgctcattagtggaaagacgccttctgagattactgagatcatctctcgagttggtgattacaaggtatctaaagttagcactaccactcatgacatggttaaaggtgtggaacggcatcgaatgaatctgtgggttgacaaacgcaaattgactaatggtataacgtctggtatttttgaacaattcaaagattatggtatgtttatcatagaggctacacaagggatcctgcgtctcagagtgtatgtagacatttcttccaacactaaaccgtatgtagtggctgaactgcgtaacaaggaagatacagtggatgatctatccggtgatttcgttgcgattcctcgtgacacactcactaatgtagagaccatgtaccatcggttcagtacgctgggcgattacatgaagaaggtgatcaacgttgacatctcctccctacagaaacagattgtcgctattatacttggtgagaaagatgcaagcatgggacaaatcgctgaactcaccgaggatttacagggtgtggagacgcgcaataccacagtagtagatacgtacgctgcacacttagagtctacgcgtgagtttgaacaccatccagccataggctcagtagtgacgacgttcaaaggttacggtgaacatgatgaactgatatacccacccaaaggagtgcatgagtcgtggaatctgctgattacagtgaagcgtgaactctctggacatgcttacattggagtcggtgatcttgtacaacggctggacggtcccacatcgtatacattacgtgtacaccacggtccgattcgtataactgcacgagatgtggatgctatattaactgcttctcctgattcaggaaagacaattcattcgcatccgtacgcacatcacatgaaaacaattggagccatgactgatactactccgagatttagggataccgatcttgggaagagagtaccctctcttactaaaggtttgggtcgtgccgcagttgaagagatactcgagcgtctgcatcagcctcatcctgataaaggtagccctgatgacagatttggtgcagtagattttctttcagcggtcggcaagagagttctaaagtcctatcaggtgagtggaattgttcaagactaacgatctaatcaggaaggttgcaaacaatagtattattcctagtctctctttactctacctcgcatctctaatacctctttggctgatcaccagtcagtcacaatatcacatgctcttatatatatacataaaaatatgcataattctgtttatttatttatttatatatttactcatttatatatcctcattattttctatccacctaacagattgactggtgtagttactggtacttccctaagccaccacaagtgtttgagagtaatgactgtcatggtggggctccgacggagtagctgagttgtgatcggatcaacgatc

SEQ ID NO: 236 - DNA, 2045 bp, Unknown
  derived from dsRNAs of unknown virus
gaatataatactttgcatttaatctatatttaaaagttttcaagaaagaacaatatgtcttacactagtaagactaaggagtatgccattgaagtcgctcagactgcactgtccagttttgagaggcaggctcgtggtacgcttgaggccccgaatggtgatgaaaacgtacgactgtacacggctaagggtggatctgctattaccatgtcttcgactgtgacgtcggcgaccatcgtgtacgatcccgaagcgaccgtgcgtaacgggcagcttaacgtggttgcatacgggaggaactccagcggtcaggtagtccaggtttcctctgttaacctaggccgcccaacggatgagttcttgtcggttggtgtgctaagctccggcctaaaagtgctaaactcttccggcgttgatgtgatcggcggtacacaatccgccggtatccttacatcggtgccacgtgatatctcaacgcttgattcgacttctctagctaacgcctgctctaaccatgagcgcgatctggcgagcggagtgatctcgcgtgacgagtcaactgtaaccgtgtgcatgaccgagcacttcgggaagaaaatggctttgtgccgctcaaacacgttgggcaacattgtgcaaaggacttgggatgatggcattggcaaccgtaagaggacgattggtcaatccctcggcccgaccgagaataaaaccctgtcgacgacgaacgttaacgcatctgatgccgatgttattgccacggattccctcaggattatggatactaacttattggatgcagcaaataaccctctcacattggccacctattccgcgagcttcacggcatacctccaaatgggagaccccgacattactagcatcagtcacccgagtgtctacgtgatgcttgcacttgatgccgccaataacgtgattgggcgatcagagatccgtgatattgtctctgtgaccgataaccagaattacagtgttaggcttaccggttcagtttctagcagcaccgtgcctattcatagggtcgttgttggcgctacttactccgaaggagtcgccgttgaaattgtagttgcgtccgccagtacgttttccttaacggcctttgaagaaactgctgatattgctgctcgccccatccacgtgtgcgttcttgagggtcttaacgcgtctgccacgctcaaccttacctcgactgcagtcttatgcggtgttccagactctaccaacgtattcattggagccacggggtcaactgtgcccgaagtttacgacacaaacgccgttgagatgttcctgaaatctattgcgcgcacactcccacgtgcgttcaccatttcagggcatggggctgttacaaggtcgcttaccgctatgtacggtgacgagtctgtcgacttggcttttaaggcaatgtcctttagcgacgttagtaagaaggcggccgatttggtgcgccaagctacgaaactcagacatgagctcgcaccttacgtcgaaactgttggtgctgcagcgtccatgcttccaggtaccgctggcgcggttggacgtggagctattatggcttctcgactcatggatatgtgaaccattgggcacttccctagcgttataatgtcaaagggtggcttgattcctggattgatccacacaattataatgtcgaccaatccaattgatagggaatacgtcttttatgatggtatttacattgatgagaacattaaaaatgtcggtacgcacatcatgaacgcatttcgtgattacggaataaaatatgtatctctgaaacgcaatgttatagtggaaggccggtcatgggaaatgtctgcggccatggctttactaaacaaggatggagtatattcaggagtggtcgacatgtatgagcctccaaggcgtttctcttttggggcggtgcctgcaattgatactaaacgtaaattatccagaaaacttattacacacatagaattgccaagagtttaatttcccgattgaaaccttgtagtatttgaaacatc

SEQ ID NO: 237 - DNA, 2145 bp, Unknown
  derived from dsRNAs of unknown virus
gtaaaaatttataaaatatttaaaagaggtgaaaactcatgaagcatatgctttcatatatcttaattacaacttcaattgttacttgttctattatcgttagcgatgctcattcagatgagttaattggtccaccagattatcacactcctattgaaagatattgtattagaaataattcagttaatcattcatttggtaaagttagatcaggcggtactaagaatcatcaaggtcatgatatagtagcttcttataatactcctacttattcaatttcaaatggtaagatagttagaatcactcgtaaaggtgctcatggtttaagtattgttatagccattgaaaatttctttgttagatattcacatctatcctctatcgttgtgagactaaatcaaaaggtaaaacacggtcaagttgttggattcacgggacaatcaggaaatgctgcaaatacagaaccacatttgcattttgagtatatgactgagataaaaccaggatatggtttaaaaggtagaaaatcacctttagaattgtttccccatttaaaggattatatgtttgattgttaataaattatacattacataaaatacgtaaacttgagtatcacaatttaacattatataggaattattatgcacatagagaccgcagtgaatataccgaaacgtgcactcccgtttctatcttctatttctaacgggtacaatgtagatgtcagaacaccacttttcaatggtgaagatcgaagtaaggtagccgatcattggatgagcattttatcacgaaatgaagaagtatttcctgaacttatggagtatgaatcttcacagcagtctaagataggtccgttatcagttagacaaccgttcactgatcgacgtagtttagtagaagactattattcaaatcatagggatgttacaattgggttatctgaacttgatttcggtaacttacctgagggtagaagattgagaccaatatcaaccctctcttccgctcgccaattgccacacggaactaactctggactaccctttttctcaaaaagaagatcagtgctagaagagagtattagcttggctgataagttcgaatttcatcctgctctactgggatggcgtggtcaatcgaatggtacacctatacctaaacaaagagttgtctggatgtttccttttgctttaaatattgctgaagctcgatattttcgaccacttcataatgaattaagcataaattatcaatttgctgcatgggaatccatggatgaagttgacattatgattaactctatgtttgctagagaaagaaccatactaagtagcgacttctcatcgtatgatcaaagtctttttagccaacaagattggttctttgattatttagtttcacgctaccaacgctcgtatgaagacgaaataaatgagcttcgtttatggttcaagacaattccattagtatttagtgaaaatgaaatgtttactggagaacatggagtaccaagtggtagcacattcacaaatcaatgtgatagcattgtcaattatttagcacaaagatcatcacccgtggttgacagcactacacctatacaagtgcaaggtgatgacgctgttataataccgactgatattgaaaagcatctcgaattcatgaataatttaggctttgaaatgaatgctgacaaacaattggtatctgatacaacggtaaattatttacaacgtttgtatcatgtcaaatacagaccagatggtgtaaccagaggcgtgtaccctacaatgagagctcttaactcattattaggtcaggaaaggtactttcaagactggagttctgaaatggtaagcttgcgtgttattgcgattctagagaacgttaaatggcatccagctttcgaggactttgttaagtttgttgtagaattcggagattcatctttaaaagataatattcgaaaggctatcattgataattcggttattgataaagctatggctataccaggactgtcacccacatataatcaagagagtggattgcgtggtttaaaatcttttaaatctgttcagattttaatgagtctataagaaagccagggaaaactgtaaaacacttatgtgttttccc

SEQ ID NO: 238 - DNA, 2155 bp, Unknown
  derived from dsRNAs of unknown virus
gtaaaaattatttaaaatattaaactaaattggtgaaactatgcgtgaaattgtaacaggaatactcataatttcagctgtggtaacgtgctctgttgttgttactgattctcatgctgaagaagaattgataggtcctccagactatcaggctccattgaatagactgtgcattagaggaaattctattaatcactcttttggtaaagttagaaataatggaaccaagaatcatcaaggtcatgattatgtggctaaagttaatactcctatttattcgatagctaatgggaaagtagttagagtaacacataaaggtgctcatgggttaagtgttgtaatatctgttgagaatttctatgttagatactcacacttatcttccttggttgtttcacctaatgacgaagtatatcatggtgaagttgttggatttactggacgatcaggtaatgctaggaacgttgaacctcatttacattttgaattactaactgagaaacaacctggttatggtttaaaaggtagaaaatcacctattgaattatttcctcatcttagaaaatttatgtttgattgttaatctttacatcttaaagcaaatagcaaacttgtatatcacaatgtttcatcatggagagaatattatgcgaatagaaaacgcagtggacataccgaaacgtgcgctcccttttctagattcaatagataaagggtatgatgtagatatcagaacgcctttgttcaatggcgaagataggcaagaggttgcagatcattggtggagcattttatcttctaaagaatcagtattccctgaactcttagattatgaatccaagcaacgagaaaagatcggcccgctttcagttagattaccgttcactgatcgccaagcatctatcgaggactattattctaagcacagtgatgtcaccattgggttatctgaattagatttcggtaatttaagaactgatagcagacttaggcctaaatcaatcagttcctccgttcttcaactgcctcatgactcaaattctggactaccctatttcgaaaagcgtcgaaatgtgctagaagagacaatcagcttggctgaaagaggaaaattctatcctgctttacttggatggagaggtcagtcaaatggtactccaatacctaaacaacgagtagtttggatgttcccgttctcactcaatgccgtggaagctagattctttcgaccactccacgatgaattaaaagagtttgaacaattctcggcatggatatccatggataaagtggactttcaaattgattcaatgtttaaatataattcaaccattctaagtagtgacttttcttcatatgatcaatcgctctttgaccaacaagattggttctttgattatttgattttaagatatcaacctcaatatgagaaagatatagaattgctaaggtcgtggttcaaacgtataccccttgttttcagtaaggacaagatgtacaccggtgaacatggtgtgcctagtggtagcactttcacaaatcaatgtgatagtatcgttaattatatggctcaaatatcatcccccgaggtaaatggtaatcctgtgcagattcaaggagatgatgccgtagtaatcgcagacaacatcgataaccatattaagttcatgacggaattgggtttcgaaatgaatatggataaacagcacatatcagatgttacagtgatgtacttacaaagaatgcatcacagagattacaaacccgatggagtaaccagaggagtatatcctactatgagagctcttaactcattgttaggacaggagagatattttcaagattggagttctgaaatggtgagtatgcgagtcattgcaatactcgagaatgctaagtggcatcctgcatttcaagaatttgtagagttcgtggtaaaatacggtgatctatctttaatagataacacacgtaaggctttgcgagataaatcggttatcgcaaaagctaatgctataccaggtcttgtacccacctacaatcaagataaaggattgagtggcttatcatcttttaagtccgttcagatgatactagatcaataagatagtatgggaaacatgtaaactgcttgcagtttcccgagtcgtattag

SEQ ID NO: 239 - DNA, 2120 bp, Unknown
  derived from dsRNAs of unknown virus
gttaaataaataaaacttaaacaatctaaatttactctctttatctactattttaggaggtattattatgttaattgaaatgcttatggtatcgactacaatagttgaaccaagactaccacttgacgaaaattttattagagataataaagttaataacacttttggcctagttagaaaccagaaaacgaagaaccatcaaggctgggactttgaagcacctttaggctcacctgtgtacgctatcgctccatttagtgaacacgctagtggtgatcatcctaattatggcttatggtttgcatacaaatccattaattccggctacatttactttaatgctcatttgagctatatcactccaatcttggaaggtacagttggatctgttattggaaatgttggtaatactggtaatgccgtgaacgtcaaaccacacttgcactttgaaatgcgtacagagtggtcgccaggtcctggtcttaaaggtagagttagtcctgcgaaaactttcggttcttggaagaaatatttacgcccagcagataatttagaatctactaatggaggaagagtcaatgaccctttcaaatgaaactaatacggattcccgtaatttaaattttcgcatagcccctttatcgtctattaatttagattctgatgtaataaagcgcctgtcccaaagtttagactctatagtaacaggtaaccaagataatcttaggacaccttttcttaaggagctaagtgaagcagaggttttaaagaaattcgacagcgtagtcgaatctcatatagagaaattaccgcaagccctagtggatttagaactctccaaccgcgacaaatttggcccaagatccatttctacaccatggacagaacggagagccagtttagaagagtactttcaacctgatgtcgataaagaaagtattaacactcattctactggaggtagactcagacaaatctctaatgctaacgcattacagctgttgaagagtcaaacttcttcaggactgcctaagttaaagaagaaggcggtcgtaaaacctatacttttagcctctttagaagatcaactaaaagctaagtatccttgtgtattatatactagaactcaagagttgcagaaaactcgtaatgtttggggatatcctatctcagatactctgaatgaaatgaaattattttctcccattcttgcatatcataaaacacattcttcctggcgttcgtccttgttaggaccagactcggtagaccgtagaataacacaactattgaatttaccaggtaagcgcgtttctattgacttttcagcatatgatagtcatgtgaaattacatttacagacctcagtcagagattatattaagtctttgtttcaagttagtgaacatgaagatatcgactccatttttgttagaatgaacgaaattggtatagttactccagacggcatatttagtggccctcacggagtgcctagtgggtcaacgcttactaatgaagtagattccgatgcccaatatttggttgcaaaccaaattataaatccaagcgatgtagcggatataaatggtgatgatggcgcttattctttaaatgatccagataagcttatttcagccttcatagaccatggattagttgttaatacggataaatcatacattaaagatgattattttatctacttgcagaattattattcaaaagagtttcagtctgacggtttagtcagaggcatctatcccatataccgagcttatatgaggttagtgtttcaagaaagatggtctaattttgaggattatgatatatctggtcaagattattataatatacgtgctctatctattttagagaacgttcgttaccaccctctattcaggttgttagtccagttcgttttagataacgacaaatttagtctcttgacttctgagaaaggaattttgaactatgtcagaatggttcaagataccagcggcactcagggaataatgatgaatcagcgcggcgatgacgtgaaaggtattaagaacttcgcctcattcaagatggttcaagaaattatgagctcatagtctcgggaccccttgggtccc

SEQ ID NO: 240 - DNA, 2092 bp, Unknown
  derived from dsRNAs of unknown virus
cgctcaggcggctgctgtgcttaagttttgtctgctcactaaccctgatcagactacaacaggaaacgtcgacgcagcagctgaagctgttcagcactacgggtcaggctttgggctggacgtcaagcggtttgacgactccacgggcttgcagtgcatcgacagctgggctgaactgatcctcgcgccggttctactggtgctggaggtaagaggtgtaatcacgacagcgcggagactgaggctcatggaaagcttcttctccgttaaccgcatgccgatgttgtttccaagtccgttcaaggacgaggcgcatcgactgctcccgcacgaggggtcggtagtatccggtctgatctacacctcgcaaatggggtcggacatcgtagactgcctgtttcgcgttgaagcgagagcggctggtttgctggattaccgcttcttcaatcaaggcgacgacgcgctcttcgcaacgcgtgatgcggctgcaattcagcgcatcatcgcgggcggtggacgcgcggggtatcggctcacctcgacgcacgaggctgccttcctgatgtcgcgtttaacgacgcgcgggccgaccgcttacaaatacctctcgcgtatggtagacgcctgccttaaccgggaagtgatgcgtgagccgacgacgctgactgcctacgcggcggcaatggcgattaggtacgaactgctgacgggcagcccgttgcagaagtacttttatccagtgctgttgagcgtggataacgatcgtatcaacgcggcggtcgccttggctaagcagttcggtgcgttgtatctagcgcagcgtgcaatgcgtgagcagagcacagaacaaatggtcgcgaacgccgaccaaactgagggcttgcgcgagctactcgctcgcgcaggtctagatgctacgccgagcgtgagagccgagctcgatcgatacacgttgcggtcgcgagccaagatttctgagctcgaagcgacgcctatttcgtcaagcgaggcgatcagattactgtacctactaactcgagacaatcaatgaggagcaactcatgagaattatcagcagaaaagcgtcgccgcccgccgcggcgattataaccgacaccaggccaagcgacgcgttcgtcattcacgaaccacaagggccgggcgcgacggcagcgcccgccgcggacacgccagttgcggcgacagaagccatggtgaacgagacggctcagatggaagcgaagcttcctgtcgacgctgtcaatctggacacggccgtccagccgattgccgcacccgcagcgtacccattgcctcatggcgtgttctggagcgacggcgtcgtcgcgcggattgcggccggtagcgtggtcttcgaggagcagacgtcacgtccccaagacgccaccctgctccgcggccggatgcatcacatcgaccttgctaacggcacgatgttgctgtgggtcggcaagaccgcggaggcgtcggaccaaggaaccactgatgacgcgccgacggctcccgcagccgaggacgctgcgcgcgaggcagcctcatcagacgcgatcgacgaaaccgagcgctctgcggatggagcgccgtcgtgactgacacacccgactggcgtctcgacgctcggtactataaagtaccgggctcgggccaccaaccacaaggcacatgttcttgcgacccggtaggtctgctgcgcactgtgctccaactcgtccgaccagagtctggccaccaccggtggttggcgtcggacaccgcatccggcgcgcgagcggcgctggtcggcgacgacttgcgtctgcacgcgctcgctgaagagcgtgttctgtacgctgccgcggacgagcttcgctctcgcgcgctgtacgcggaagcgcaatatgtgcgcgccgcgatcgcgcgcttgtgcgcacaacatgacgagctattcgctcacttctcacacgaagcgctacgcgctcatgcaagagacgagggtcgcgtcttcaccgacgtgaccactctgctccgtactgtcgcgcgtaagcagtaaataaacgggagctataacctatggttatagctctcgttcccc

SEQ ID NO: 241 - DNA, 2060 bp, Unknown
  derived from dsRNAs of unknown virus
ataaatttctctgcaagtggattgccgcgatcaacgagtatagcacgaactacaatggatcgtaacaggacttttcaaattcctcaatatgcgccccaccgcgacatcttctctgctacaacagaggaagttgctgagatgcatgagcagttgaagagtggttcattactgagaggttttctcgttgtcgagcaaggacagggaccctactacgtagtcgtcgtcgatgagtcagtgcatcaaggatggatttataatgcacgtacggcaagactcgaggtacgcaaagtagtgaatggtatgtacattggccagaatgtgatcccagatgagcacggtgtgatgtatcctggaaggggtgagccatatcatgatctgctactgaaacttctcaatgacggtctgatgccttactatcaatatcaacccttaaatgtatcaggagcactcgatttgacacatgaatacagtactgaaaccgtacaattggatctttttgggaaacaaactagcaaatttgagttctttcctacccccagtctctccaaacttagaaatgctaacatcccgtgcaggcgtatatcgagaattgagaccagtagatgcgattggccacacgtttttgttctggatccatacaactgcacattagtaaggctgccagtgttgcgtatgttctctggactgagttacgaaggtggtgttcagcaggataagacagtgtacttagtctacaacccattggaattcattggcatttggtacgttggcagtggtaggacagtagcattacagaaggtatgggtaaagcgtatgttacgagatgcgatcacgtcagatttctgtgatgtcgttgagcttgaaggaaaggccgcgcctactgcccaggagctgtttactgacgctgtgaacagtaggtcaaagagaggatcagacaatggaaagtggatagcaacgatcttcgggtctaaactgcctcgatttgtagcgctgaagagactactctctattggcgatatgaagaagattcaggttgagagtgaagctgccagagactacatcctgtatgacagtgagtacatcatgaccatatttcatgagcgtaatggatggatggcagtatacgaggagaacgtggaaaggacgctgtcaactatggttacggtagcccccgctcccagacatgcacccattaaatttagcaagccctatagatacatggtacatcgcattgtagaaagagaacacactgaagcacttcgtctagctgagcttggactcgttcctaatggtaatgggaatatttgcactggatgctcttcggacagcgttgaattcatggatcatgtggagaaaggatgtctgtacaccattaggaccttgggactgtatgtgtgtactagtgcctacactcctaagtggattcaggatgaattggatcgccagagaatacctgcacaatatcgtaacggagcgttcggaccaatgttggcacagagtggtacacctttaaccctgagtcaagcagtgagcattctgatgggcaacagcactcgagggcctcaaggcgcaggtacactgatgcagatctcctattacggagtgatcgcccctccagtgatccgcaagcatcgtccgagacgcagaatgacacgccacgacagtagaacctaaatgtgcatgtatgaacattgtcttttactgtttctaatatatagccaatttactattatcttcatatgtttagtttataatttcgttgttttcatttggatttaaatgttatcttttggtaaaattcgtcgttgttcaatgcctgtatgtacatatgttaaaattgtccactatgcttattcattcttgccagttagcttcatcatctatattctttatactatgcttagatcatcgcgatgggtactcttgacattatactgcatcttgagtattgtattatcgcattggcgtgcgccgtatgatctgccgcttgaagctcgggctacaccggacctggaccacccgggagtagctctaatgactgagaaataagaacaacgatc

SEQ ID NO: 242 - DNA, 2109 bp, Unknown
  derived from dsRNAs of unknown virus
gtaaaatttaacttatgtaaatcaaaacaaatacttataggagtttttctatgaagattgtgtatttgataggaatattcctatctagtacttgttcagctctagatgtcacgtttccaactgattgtccacgtataagagaaggatctctgaatcatacttttggattagtacgtaatggaggaacacgtaatcatcaaggctgggatttcggtggtaataaaggtgatagaatcgtagccattagtaatggaaagatacattccattggtgtcaagaagaattatggaaagtatattttacttgaagctaaatctaacgccatttatttcttttacgctcatttagatgtaattactgtgtcatcaggtgataaagtaaagaaaggtgatgtgataggcaagatgggtaatactggtaatgccatcaatacaccatatcacgttcacgtggaatacagaaccactccatggcctagtttaggtttagaaggtcgtaaatcactattcgaaatatttgaggttgaatttcactatttattacgggataaatatccttgtgataattaaagttacaactagtaaaatctactttcacattatgtaggagacattatgccaatagaaaacgcagagcatataccgattaatgcactcccatttctaaaatctataggtaatggatataatgaggacattagaacacctttattcgggggtgttgataggcaagttgttgctgatcaatggtggaccattctatcttctgtagataacttgtttccagaactgattgatttagaaactaagcagaaagggaaaataggtccactatcaattagattgccgttcattgatagaattccagatattaatagttactatactaatcatagtgatgtggaagtcggattatctgaggttatcggacaattcgtaataccgggaagcagattaagacctctaagtgcccggaattccgctctccagctacccacaaattctaactctggccttccacttttcaggaaaagaaatcaagtgcaagaagagagtatagcaatggctatgcagaatgaattctatccagctttacttggatggaggggacaagctaacggtacaaacactcctaaacaacgagtggtatggatgtttccttattcattgaatatagcggaagctagattctttagacctcttcatgaaatattgaagaatatgtatccattttctgcttggataactatggataaggttgatcgtagtatcacgacgcttatcgactcatcaagaggcgagatactgtcatcagacttttcatcatatgatcaaagtgttttccaccaacaagattggttctttgatatattacgtatggcttaccagactagctatcatgatgaaattagtatgttgcagcactggttcaagaatattcctttggtgtttagtgaaactcaaatgttcactggtgaacatggagtaccgagtggctcaacatttacaaaccaatgtgattcaatcgtgaactacttagcgcaatcatcatctcccgtggcaactgacttaatacaagttcaaggagacgatgctgtaatagttgtagataatgtggatacacatttatcacatctcactaatttgggtttcgatgttaacatcgataaacagctcatttctagtaccatggtgtcatatttgcagagacttcaccatcgcgattacagaataggaggagtttgtagaggagtatatcctaccatgagagctcttaactctttattaggacaggaaagattttaccaaggttggagttccgaaatggttagtttgcgcgtattagctattctagagaatactaagtggcatccagcctttaaggaattcgtcaaatttacggtagaacatggtgatctccaattaaaagagaatgtcatgagtattactaaagataatacggttattagtaaagctagaactataccggggcttgtgcctacttacaatcaggagtccgatttaagtggattatcgagttttgaatccgttcgcttgataaaagagctttaagatagttcgggatatgtaagcattagtttgctatccc

SEQ ID NO: 243 - DNA, 2080 bp, Unknown
  derived from dsRNAs of unknown virus
gggaaaagtcccataaacgaaaactaaggaagcctacggaaccggaaccatccttagacctagtgtggtagcgccggtgtgattcgtggacggacctagtaccaccacaaggagaaaagaaaatgaacaatgatgttgtttttggaagcctgaataacgattgcggaggtgtgccgtatgctcattgagagcatgaactacaccaagatgatggaagaccgatgccgtgccatacatatggctgaccgcaccacctggattgatggtggtgtcggtttgctccagtctatgctggcgcttggcactgcatggtatgtgcaggacctgcccctccaccgagtgtgggcaacccaggacgaagactacgagtctttagctgacctggaagaggggaagttctactcccctaccggtaccaccgagttccgggacctcacggttgagatagctgaggtcgctgccggaatactcagggatgtgatcgtcaacctggaccatgtagaccgatggggacaggaggtcaagacaatctctgagttctggtgcgagcgctactgcaaaggcgcgtacagcgataacgacgaaggggtgcaggctaagcatgtactagacagcttcctgaaggagtacaaggagtacggaacaggactcggtctagtgtggcggttcgccagtttcaacggtatgcccacagtacagtggacagttggtaactggtctggactgcttcgcccatttgtaaccgacctttcggatgagaaacccgagatggtacacactcacaagtgcttatgcatgcagtgtggcttagaccttgatgcgtctgaggaaattttcttccttgacgaaggaaaaccatcggcgacggactccgtcaagtgcggttgcggcaagggtgtgaagacacgtttcatcttggctacgtcaggaaagcgcgggttgtctaagttcaccacgaaccagcccggttcgtacggtgctgtagagacgacgctgcacctaccaggttgcacaaacccgtactgctctatgccaaaccgtgccataactaggaggctattcgaccagcgtggtaacgactggaggaagctgaagcagaacgtgttccgtatggaagcgcgtgagaaggcacgccgcaagcggaggggaaagtagtgcacaaagtacctatgaagtggttaaaggagaaggacctatgtccagatcctttaggcgactacgacgagtggttcttgtacgtgcacagtctcagactcgaggcagagatactcgagtatgggtactacaacacgtaccccgtgacaggaaggtgggtcagttggaggtgaaccctttggacagggaaaacttcccgttcgagaagctagtgattatcgctagctactctcagcactccacgttcttccacacaaggaagtcggagctaaacgctgacatcgttgaggacatcacagacatctgcgatgtgctacttcacccaggggatgactggattgactatttcattagtcttccgtaccctacggtggtagtcatacctcgcactctacggtgggagtggcacatagacagggttttcgagtacgcacaggggcccagtccaaccatggtaatggatgttcatcgtagactagacatgaatgccatctcacgtgttgtgagcgactggaggcgcgacaatgtctaaggttcctgaaagtgagtactggaagattatcctgtacagaggttgcaacctaacgcacgagcacattgcgtttgggttcgacgttgacaggagcacgatttccagaatcctacgcgagattaaagctaggatgttcgaggacttcggaggtgaccctttggtcacacttctccactatgtgtccattaaggacgacgagtagctgtcgagagattaaactcacaccttcgggtggcgcatactacagagccagcatgattactggatgcgaagaaaggctggttcctgacagcgactacgtaaagcgttcccaaacgctgggttttgataccaaggcaggcatggggcctgaccagaggggggctatggagagctcagagtacatctccaccc

SEQ ID NO: 244 - DNA, 2027 bp, Unknown
  derived from dsRNAs of unknown virus
gatactgaaaggtgaaacacccttgatgacgtatctgcacgtttccgcatctcaacgcagagtggttactgttaagggagcgtggattcacaacaaggagtagatagtatatggaaaataatttagaaaatatgagtaaagtcttcaaaccggaggaaataatgtccatcgctaaagtcaaggatttatacaagttcttgcctttcaaagtaggcggcgttactttcaggtttgatgatacagaaactggcgttgtacgcgcaagtaggcagggctctgtaatgagctatgctaacacgcctgccgtgcaattagtcacacgaggatacgaccctcgtgatatgcgaaagttagcagaagagactatagatagaaattacgacgaaggtctacgagcctgggaaggcgagtgggatgacgttctcgaacctcgaggcgcaagcaactggtggtacatgttggaaatgatgagtataatgggacctgagggttcccccttgaagaagggacccattccgtatgattgggatttatactacgaagcagttgacgttgtaatcgataggatgaaatcggctatcggtggggtgatccaacctaaacatatagcaccttccacaccgttgtcaactgcaacgtcccttaggatggcgcacgtcgcgcagaattccgctggggagccgttcttctctgactcaaaagtcgctaagacttcaaaagctacgaatttgaagtcagctgtaggactagcatccaagttttctcaacctggagaaaagtcactgcctttatacccgttcctggcgttcgcgagattcgacaggaaggggccttggccgtattatcttgatacggatgaggccagagcatatggaaaactagctttgaaatggcgtatgatcgccgcccagaatttcactttgcaattgatggacggcgccgtaacgcaggcactacaggaagcagtcagtgcatccgctataccagaaatagactgcagggatccagcccgtctttcggatcatttcgaagacggcgcaaggcttgtgaaagagctcggcaactccgggttttcaattggatccgaccagtcggcttgggatttgtttacgaatcctcagtcatggtatggagcattcttagtatataaggccctattccctgaggaggctaatgtcctcttcgtggaaactgataagtttcttaaggtagaaagccctgccttggaacgttttaatgatttggagattgggaaatcagtcaacgccgaattcacgtatatcgctgaaaacggtgcccctagacctgtcgaaacccgcgtaacccgcttgggaatagacatggacacgtatctacgacgtgtattcgcttcggcctccggaaccggagctgcattgggacaaattaaagcagacgggtataaaacagttattgacactccccggcacgggaaattccagtgcgggtttggtcagaggtctggaaacttcggaactttcatgactaactgttaatgaattggatagagcaagtgtacatatcacttgcgagtcaaaatagtgacgcactcgaccgtttcgaaaaggagatgggttatcgccctcccgcaatgcgcctccggtggattgtggtaaggggtgatgacgccgccgctgtctgggaagtcaacgacatcaaggaaggtgaagctgactggaaaatatcagaactatatgcggactggctaactcacgttggtaagaatgccaacgcgaagaagcaagaagcctcagatgttaggggtaagtgggaaattgggttcgctcaaatctacagctctgacgtatttccaagaggggttaaatcagtcgtacgtgtattggataggatgatatggaacgaacaagatgaggttgtgccttatgatccagacactggagaggatctccgggacgtcttagtacctcttgctaacatgggaagaatccaaggtctatggggtgctttcactggtgacgtccacccacgagctaaggagttcactgcta

SEQ ID NO: 245 - DNA, 1992 bp, Unknown
  derived from dsRNAs of unknown virus
gggaaaatttcttttaagaagaacttggccgggtcctcaggttaccgcctgcagatctagcgttttccttagtttaaggaggtaacgaaatgtatcaagacagaaacaacaagaagtctccttctgtacgcagaaggcggatccctacccggagtagggacgatactggcaagtcgcgcgcgccagatcgtcaaactaagcgcaagagcggaccacgcaaagcggtccgttacgaggaccgagcgttgaggcatacactcagcgacatcgtccgaggccacatgcgtgatggaaacatctcgcttgaggatgccgcaaaggtaggactgtacgtccacgagggtattgagtactctccccttcgcacaacaaaagccgagtctggccccagctggactgacttacctggtgtggagatcgacgacagtgctaaatctttgttagaggatacgaccgagcttgacttaggtgacggagttgtccgccaaggtaaggattacgcttaccaagagtggatggttttcgctgccaaaccagtcgagcgatgggttattccgaagcatctattggccaaggcgaggaaactcggtatcctgaagaagcaaattggctttgagtaccaaccagagcgcgtaactcgcgcttgtctcgaggaaatttgtcaagaagtacatcgtactggcggtagcgtaaggcgccgacttgacagaaaagaagagaaggatggtgttcgctgatggagtacgctccatacgtcctagatgacgtatcagttgacaaggcgcttctgaaggcttgttcgaagatgagtcgcggtcttattgattacgacttcactgctttcggttacggctcgtttctacgagtagggtacgaaagccttgaaggtaagcattgggaccaacccagcgatgtgaagcctgactggatgctgtgtagctctaaccaatgtggtatgagtatgcgcatcggcaactacaagttccgaaacgaactctccctgaaggagtggacgattagcggaatgtgccaagtatgtcaggatgaaatgtacgacagagtgaagccgcaaggcaacacataccacgaagccgtcgagcacgacaacgtggatcgctccgccgatattacggctgagagaggtgttgttttcggtgtacattgggacgtgattaacacactcgagaagctcgattacaaattgttcttgtggcaatctaaaatcgacatcgattcgttaatcaactggacaccaatcaacatgttctggagtagacatatgctgggaggcgatgatgatgaatgaggaatctcgtgctttacgtattaaggagctagacgatttagtctcagctcatgatgagaagtggggaccatacgtaccctttatcttcgtaaacgctgacaagacacagagccgcatggtgacgttcttgcacacagtcgaaggtaagacattcctgttagtcaccaagctgtttaccgacagacctgttgacgacagaacttcagtgaagctattccgcgagtcacaactcgttttaggagttatgagttactggagaacgaatgagtacgtaccgctacgcgtgaaagaagctgacagctttggttcttacatgaacgcagagtattaccagcttttcgaagcacatgtcgagataatctttcgctatcgcaagatgttcaaccttgaaatgctcaaggagaacatggagcgtattactggcgatgtccaagtatcgattgctcaaccagtttacaagtaccttagtagcttgaaacttgagattgacatcggtcaggactaccgactagccgccaaagagtggtataagtcgcaaggttacgactagccatgcgtagtgtagccacaggcacacaactcaccccgaactggtgaacggggagaatccacagcgaaagctgcaacaagtcgatggaggtaagggcagacgccaatgggctcacccctgccctcctccatcaccc

SEQ ID NO: 246 - DNA, 2021 bp, Unknown
  derived from dsRNAs of unknown virus
gtaaaataagaacatcagaaatacaaaacgttaaatcacgcaatcagatttcgttcaattatatttactgattaaagactaaatttctatagccataggaggcaacatcacaatggaagagaaagacataatagaaagagagtttaaacagttcaagattaagcagcttcgaaacctgttagtcgcactctgcgcgatgtatgcaaccggtttcaatcctataatagttagatcaaagatatctgacatagttttatttagcgcagttgatctttggctaatctttggtatatctaaacaaaaggagaagagagctaatggaaataataaattctaataatattgcgagttttcaagcttcaataaatcaagaccctgacataaattctgacgcactaataggctcgtctagaacagcccgacgcaacagaaacaggtcgagatcgagacggaagaaacgtgaacagttactagcccaacacaagtggatggatcgctttgagctcccaccaaacgctgtgaattcgctactgactattctaaatggtgtagttgagggatcggatcgccctttcataacgcccatcggtatgaaacacagtcctgaagtattaatgcaaggatggactgaaatctatgaatcactagaccacgaggcgctgacgccgactttgattgaaattgaaaaccagaacaaggaaaagtatggacctagatcgatccagaaaccttggtctgagcggaaaggttcagttgaggaatactttgcagtttctgaactagagccgagacttaaggaagaaattattaaagttgcaattgatgaaggtaataaacaaaacagacaatttagaccagtttcgagagagaatgctttatctcacttgaagaaccagacaaatagtggtcttccgctaatgaaggctggtaaatatgctaaacaaacaccgatggatgaccttatagctcaagaaggtatggattacccttgtgtactatttacacgaacgcaagaacagggtaaaactagaaatgtctggggcttcccatttatttggaagttattagagcaagaattttatcaagttttattaaatcatcaaagacaactacactggagagcagcgattttacatcctgacgcggtcgacaaggaggtaactgcctgtatagataaagcaatagctacaggagaccagatactttctgttgatttctctgcttacgacgcttcaattgttcctgacttacaattagcagcgtttgagtatataaagagacttttcagaaaagaatattgggcaagaattgatagtatagctcataattttggtaatattggaattatcactccggaaggacttcgagagggacctcacggtgtgccaagtggtagtacctttactaatgagattgattctattgtccagtttataattcagcatctatataaaggaattaagaattttaatatccaaggtgacgacggcatctacgttgtaccgagtgctgctgggttgatggagcatttcataaaatacggactagaggttaataagtctaaatctttggtctcagacgatggcgaaggcctgtatttacagaaatactaccatccgaaatatagacaggaaaatggcgtaattggtggcatatacagcacttaccgagctctattgcggttagtgtaccaagaacgctttactcaattggaggacagtggtatcacagcagatgactactatgcaattcgttcgatcacaattatggaaaattgcaagttccatccttattttgaggaattcgtgaagtacatgtatgacatggacaagcgtctaggaaaggagtttgaccaaatcacaattgatgcgtatgtacgcaaaattagtgactctatagggggacgagtaatgaagaaccaatatggtgacgacatttcgggaattaaacagttcgaagtgtataaattactacgcaaattagagcaaacttagatagaaagggatttattccctttccac

SEQ ID NO: 247 - DNA, 1958 bp, Unknown
  derived from dsRNAs of unknown virus
ggaaagattggtcactttcccctcgtgtgtgcttacatgtcttgtacatacaatgaggtcggctgacaacccatgactcgtggattgactagagtctagctttgcttctagcataaaaggagcttccgggccgtatattgcccatccaaaaattaaatacaagaacccaccggtaagtgggaaggcttgcgaatagaatacatctgcataatatacggattgtttgcgtataggttgtaaaccttattctttacggataccttcattaccaaaatttaaaatcatgacaatatattcatttagaacgttcatgcgtgaagtcagagtcaaatatgacccttcttcaatcacaacacatctcagaggtgactggggaaagtttcgtgtgaggcacggaattagtacagttcgctcgacaccgtcgcaatacttgcgatcactaaggtgtttcggacaaatcagttcttcttactggagagatgttgctgatagaacgtctatgactactcgtctggatgcattctgcagtaaaagggaaatcgacttcgatgccgatatactctctgatgctgttaagattgtttcagataaatttggatttgataatctcaaacctcttcgattgcgtgaggctgttaatcagttacctgggtcaagctcagctggttatccttaccaaaagaaacgttcggcttgccgaaccgagattgttcatgatgccagtgttgtaaaagacactttacttagaggaaagaaacctctagtatacccttgcgttgcatcagctcgtagagttgttcgtgaacgcggcaaaaataagccaagactagtttggtgttatccaggcgcaatctcagctttagaggctactttcgaaggtgcttctaaacataagctgaaagaactcgagttcttaggttgcaatacaaactggatgtccagagatagctggattaaactcttcgacgtacaatgggagagtattatatcactagattatcagggctttgatgcttccgtccctgcattcttaatccataaagcttttaaaatttacaagcaatggtttgagttgacggaacaagaagatcgtttactcgtttttcttagagactacttcgtccatactccaatagtattttatgacaaagtcattcagaaacataggggcataccctctggttcatgctttacgtacatcattggtacgttagttaatttgattgcgtcaaactacttagcattaagctgtggttttactatatcgagtgaccgctctaggtggtcaggcgatgattcccgaatggttactacatggggcgagggcccagtatccattcccactctatctgaagtatgcggccatcttggccttactatcaatctaacgaagtcggatgttagattaagtaatagtatatttactgacgatggacctgatatgggaataggttcttttctttcaagagaattgaatcgtggttatcctaacttacgttttgatcgcgagaaagctttagcacaactcattataccggagaaaccggataaaagtgtgcatgatctagctgatcgcataataggattgacgtatgcatatggatttgataaacaaacttacgattgccttgctgaggcgtggcagattgttaaaaattcttatcgtggtagcttagacattggcggtgagaggattaggaacaagatgagatggatacttaattctgaagaggaacttgattggtcctttaagtcttgggaattttatcatcagttatattttgattacgtctaagcgtcgtgtctcctacgtagtggagtaagcctttgggattcaaggtgaagtcaagttagaatcctggcgtagtatgtgtgccggtgacaacaagccaaatcataccctgcaagtacctgcagagaagtgccaatacacttaaagggaacatcttacgagatca

SEQ ID NO: 248 - DNA, 1820 bp, Unknown
  derived from dsRNAs of unknown virus
gtaaaataagaacataacaaaagtatttacaaacgatcatgtatcgtaaactattacatgttgaccccttatatagtttaaaattattaacgtaaagatttaagcttatgccaaacaataaagatagttctgcatttgctgtacaaccaggaataaagaatcatgttaacaacagacagccttttgctaaccggaatcgacgacgacgtcctggagatgatcaatctcctaatccaatggtagaaagtgatcgtgttgattacgattcagtacctgtaaagcctaaaagaaaaggaagtcatttaaataaagtggctgaagaggcgcagttcaagcatcagcagtatagacaatcaagaaataaaagcaagactaaatcagacttcgacgttgaggtaggtttcggtaaaggaaactctcgtggaagaatgggtgcatcaatgttacgcagaaaaggtaatactagccagcgtacgattttctttgatgaaactggaagtgaaccagtaacattagagcgtcgtcatacacatatgttcccagatccataccgcaatccgagtacagttgaccctaaagtatttgttaaatcattagaattcaacttatttaaatttattccagcagacacatttgacacagttattgaatttgagcgtgaatcgctattcaagtcaatgctgcaagatattcgtagaacttttacgagtccacaatatcaaaatttaactactcagagcttatttaactatttcaatgcggtgtccagagcagttatcgagtattacgaaattgattcactaatggcgaatgatgcctataaatatagtgacgtaaaccgaggaattcgtttattaaaggattcagctgcaaccgagacacgactactagagacgcagtataaattacgtagagcaattcaaggttcatacttgccaactaaagttttcgaacttattagatgggcctcacaatggtatacatttaatgaagaaggcgattcaagagctactgcttttaaatttagtttaggattagggttaaagaatatttgtacagccggtagtgcagaaattgatcgacgaccagcttttactcacccagaatattttattcgagtaaataatttatgtacacaattattcgagcaacaagaagcgccaggtatccaagcggcaattgctaaaacattcccagaatgggctattaatgacttgcctttgtcgtgcaatagaccgatttatgatcaaagagcaactgacctttggttaaatcaaccggctttattgaaaactaatactacagagtacgttgaaccagttaatgaaatgagtttagaaatggctactatggacgaaagtggcttagaccaagtagttccaagttgtgtttcagtccgcgcaattactcaaatgcgtactgactctcaattagatgctattctaactccggattaccatttagcacaatggaatccgactgtgaacccacctcgctgggacattggatattcaattattagcacttttggacctcaagcacaggacccaatggctagttgttgttcattacaaatgaataatttgaatttaccaattttcacttggctagatgaacaaacaagtcaggctttacctgacacgtataaattagcctataataatggttttagacgctatacacaatttaacagtgaagtactgagattaaagccaatgacagagtcacagaaagaaattgaaacaagtgaatttgtcactcgtcttatgacgggttaaaggccgtaggcaaggagaacgcaatcgtgttctccttgttcc

SEQ ID NO: 249 - DNA, 1847 bp, Unknown
  derived from dsRNAs of unknown virus
gtaaaatattacaacacaaataaaatccaattcaaattttagccggatttaagaggattcgctttgacagcgtttacattttacactatcaaccaactactaacaggaggaataatactatgtcatcatttggtattattggaggaggtaacttcggtgccttttcaaatcgcggaatgtcgatgacttcaggaccacgtcgaactaagcgtgtaccaggagatcccgtttctaagacagcaggacgcatgggtggaaagaatttccacaacacaggcgcaactcaaccaattggaccaaaggcaccagagatgggacgaccttccaattttagtgacggattacgaactaaccaaccattagcaatgcgaggaggcgattatatgaaagcaacacacaaaactttaggaaaagggaaatctaagtcagcacctaagcgcaacttccgaaacggaggaggcggaggcggtggaaaccgtaacagctacgttccctaccacggtgagccaacaggacgttcacctggaccagcaggtacattcgagtctaaagtagcatcaaatgctatctctactgcaatgttacctactgtaggtacagacatgggtacaggagcacaccttcaagtactcgacttaccaacacaagaatattctgattcacgtttatacgttaagaatgtttcagtaacacccacaggtttaaacaaaccgacatctgaagtatacaactacttcactaactatgtatacccagcttacattaacttattacaaactaatgtaaactacaagattgatgtgccagtaacacagttccagcaatggttctttaacttacaatcagcacttcacctttggttccacgtaaacaagatcattacagcttacgacagtcaaccagctctcaaccgtggtatcaaccacttacgtgagcagttaacagctgaagaacttaacttatacgataacttaactaagatgttatctactaaggtgatggatcctaagatggtatcatttattcgttggatgcacgatttatacactacgtcaccaactaaccctaacgccgaaattcttatgttttcttacgataacgtaattcttggcgataacatccagactcttcttcaagaggcgatcactaacatgtcaaatgttgacttaatcaaagtgaactcacttatgcttaaggctcgacctaactggatgatttcactctcgaactacagcgggcaacctaagtacgacgagcagttctacacttactgggctaatacaccagaaaactaccttgatctcgagaacgacaaccaagagtacatcaaaccgtacgtattctcagaaacagaagggtaccgcgatcgcgcacacttcaacatctacggtaacgaatactcaccgctccttcacggacttacttgtttccacaagtcagcagacggtaaagttgatccagcttctgcaacgcaaggtatttactacggttttgtaacgccagcttacttaactacacgtattcctacttcttacgttcgttacgattcagttaacgaacagtttgttccagcaggatacgctcaaggaggacagcttcgtactgcagcattaatggcatcaccatctgcatctacgattctctttgattacaactcaacaactggtcaatacacacttgttgataactggccattctcatgtcttaagccacagtgtcaagagccgatctcaatgtcgatcagcactgcacgacaggacttcaacatcggaatgcgagatttattctcatggagtacacttatccgttcagacgcataagtctccgggacccctgtggggcccccc

SEQ ID NO: 250 - DNA, 1824 bp, Unknown
  derived from dsRNAs of unknown virus
gggaatttattcaacctttatcaaggttcatccaagttgttcatctaagaacatctgaatcccccgtaagtattcgacgacacagatgctaattaaccttattttacaattattatgacaagaatttccatttctgaagttcgcgcaagttttaatcagttgcaataccaggtttctaaattagaatccttaacattttttaaggcttctcactctattggctcatcgaagctaagatctgcagcttctagagtcaacactccactcccttttaaaccttttatagatttaatcgaaaaatcacttaatgtgagttttcctactaatcttgtgtttacacctgaggaagttcgcaagcgagatgttgatcaaattgctgcataccaagtcgattttgacgcattacctaacatcaattttaattattttttaattgcaagtattagtgcatataaatcacttggtttagacagacaagatgttttttatcttacgtctgtcgaacagtccgctgcctcatacgttaaaagtactagtgcaggatatcctacatttaggaagaagggaagtgatgctgctattaaagacgccacgtcttttaccaacagttttatttcaagcccttctttaagcaagataatgaagggttgtccttgtgctgtattccaccgctaccagtataatataccggtttcggaaacacctaaaagcacagctcccgtttacaataaagaagtaatccaagacggtttaagtaatatcgtaaagaaatcccgacaagtttggggtgagtcctttcgttatctaacattaaccgccgtttatttccgctcatttgttgacgagactactatttggaacagacaacaggaagtaccaactactacctacggtctcactaaaagtgaaatttctgagcgtattatacgacgcttgagatcaactaaaagagacattatatctgtagacttctctaaatttgattctactgtacctcgcatatttcacattatgttttatgcactccacttagcgcatcattcttatatgctttgtcctaagataatcagtttgatcactgtccattctattagaacaccgttttgttacggttcctcagaacttaatttccataagagaggtatcgcctctggcgaacttcttacttctctttttggttcttttgtcaataagactattattaatttagcctacttagaggtaaccaacggcaaacaaactgctgaatcggatgcagtatccttaggagatgatcttacttacctttcaggtatagtatctctgaatcatttccgaagtttatgcactcgtttaggtatgaatgtggacctagagtcttgttatacatgtcattttgacgaacccttccctttcttagggtacatatgggatcgtgagaatcgacccactcagctcgttcagtggtacattgctcatttcgtaataccttctggttttatacgcaatcgtgccttacccataaaattgttacagacatatcgcgccatttctattgccatgcaattatatcatggaatggacatatatgacaaacttataggctatggagacactgtctataaagacattctttatgagtacaaacttaacggaaaagacccaatcattttttatgaaggtcctgactctagacaggtaggaattggttttccattatctaccattttttcaatagggtgggaagctttttagctatcactcgaatactataatgctataactttaacagttttgcattattaatactattactatcactagtaatttagggggctggtaccc

SEQ ID NO: 251 - DNA, 1782 bp, Unknown
  derived from dsRNAs of unknown virus
agtaaatttatttaccttttaataaatgaactcggtccttgggtcacgcggatcgttaaaggattcacattgaagcggggcaagctgatatgtgataaaatcctaaagataacccggatgtgttgaatatggtaagtacgaaacttaaatatactggacttccgaccgttaattcgttctttaaacgtattaccgagtcgcagatattcgatcaagtacccatcgttcaatcggttacggcaaatggacctttacttaggcatactgtagcgaataagcacgaatttcttaccatctctccaattggaagaggtgctggaatatatcgttctaaatttgacttcagctataccaacggtaatggtacaccaagtagttccagtcccgatagggatgcctactttggcattgcgtttgttaatcgtccagcaggaacttcaagttctgcaggcgttgtaatcgctggaattatgggaataattgaatcgacaacaggtgtaactttatctaaatttagttactctaatggaacactcactatcggtggttccgacggtagaagccttgcggtttctgctttaactgaaggagatgcgaagcattcgctagatcttttccttgacgtaaatgtcaatgataaaatttctggtaatgacgttgtctatacctatggttgtgacagttacctaaaacttaacggtttaaaagtagctcacgcacaaactattatggatgacgctattgttccgaatcttacaggttactgtttcgtcggtggtatgagtgatactgtacctattaatacttataaccttcgtggtgttgagtatagttacagtcaatccacttccgaaatcttcggtttattagaggatctctaatggtaagcttagacttcctattagatactctcttacggagaccaggtggcggagcaagtgattcatcaacccctggagctgtagctaatccttactacaatcctgatcctagcggaacaacggatggtagtgatggtagcgaagagttccacgttcctccagagttagcgtatcacgacgacaatgatccagaagatactgagattgattacgatctctttattcctatgggtaatgttggtatgatacttgattttctcgatggagatgatgattccttgaggtctggttttggtattaattatactaaatactatcctcagaaagagattatcgaaccgatatttgaatctttgggtatcgcagaagaagattttgcgaaagccttcaaaatacacgaacctataactgatcttcgtttagatgctatatggattcctgtacctacattagtacatatttactatttaggtcaaagaatcgatcatattatctttgctccaattcctggaacagaaggtctgaccatagatggtaaacctgccctttgggtacaacttatcgtcgcggtcgcactgtatggtttaattctatggagattccctcaagtcataggattaatgttgcgatctggtctaattggtgcgggtgttggggtaacatcgaatttaactgctagaaagtatagagccgcagttctttcaggactagggaataacgctttaggtattgatgagatcttagatgatcttgctactttagctacaagcctgtttgaaaacggcgttacggattctctgtctgatcaagacagcgaattaattcgtaagttaaagctttggactagaactctatagcatcaaagggaatggaaaggagggtcaaacctttcttatacccc

SEQ ID NO: 252 - DNA, 1786 bp, Unknown
  derived from dsRNAs of unknown virus
gggaaaactcagtcccttaccaaaaaatcgaggaaatttttcttattatttttttaataatttaaatttatttttctagtctcgtgtccatcatcgccttaacaggtgcgagcttctcgcttgacaatatttctatatagctgaataaatgcctagaataagatttgttaatacgacaagcctctctaataatgaaggaaatttcgaagacgaaatttcaagtgaaattgacgacgtaaatagacttgcgtcaaaccgtggccctgggggtttcgggaatacacctggtaataataaccagaatcgaaatttaaatagacgtggtaacccacgtagaatatcaccgagtgctatggatcagagttatttaattaacgctgttcctaacaaagtgatccaaacaatgaagtggtctaacatttttgttggacaaaaattcattgttggtggtctggtcgaatacgccattacatttggtattcgttactggacggtcatcctggtgcaaaaagttctcttcaatgaagtgactcgtagtgagtcatatcatactgttgaaagatctgctcctccagtcaagggtttaagcagactcgagtcaacagagaaatggttccaggaggccttttttcttgcgtgttatattcctacatacttgtatgaaaagaaatatgaacatgaagttacagctgaatttgtccgtgaatgtgaaaacatctggatgcctctgtcgatttacagacagatagccatcgatcagtcaacactcaagacatttccgctgggagaactaggcctactgcgttttctagttacgctgtactcctcggactccatccgaaaggttaaccccaacctcgctgaaaagtatgaaaagggacaactaagtaacagcgatgttcaagtttaccagatgtttctcggtaaatgctgtaatttaattggttgccctcttttctcaatcaacgatctgtttgggaattttgatacaccgatcggctctctgggtgagactgtaactatccaaacatcgggaggtggggtgttacacatgctatgcccagagtactcaacgacacaatcggttgcattttcttatatgtatgcaacgtgtccttcaggtactgttccatataagccagaagacgaaaatctgctttctggaatcagacaaatgtctcgtctacacgccatggacgatgacgaggctcttttacattataaaaacctcatgactaaatccgacgaggtgtcggaagttgaagaagttttctggtcaccagaccttgaaaacccttcatttcttttggatcaacaacacatttctgctttctcatttacccagactgggtggtctccttatgctcttacatctgagatcatctcccactttctgggaattgatattgagcaccctgtagttggtccaaattatgatggttcgttcaacgatgatctagggacgggtcagaacgtaccttcaggtccatacgggagtggacctgttaacccaggtcttaaaggcattgttaaggagatggttaactctgggattggccaagagcttgcatccgatgtccttagctatgcagtacgagttggtttacctggtgtcggtcctgccatgacaggagtccgattcggtaaggaattttactcagctattaagcaagctaaatcctcaccacgacctaaagcagttcgtctgctagggcaggcaatcaaccgcgtacgcggtaagactggtaaataactagaaggatggacaccgtaaggtgtccatccc

SEQ ID NO: 253 - DNA, 1794 bp, Unknown
  derived from dsRNAs of unknown virus
gttaaataaataaaactttataaatttcttctatgaaattttaaaattcaaatcatttaatctaatcaaaccagattaataaattcacaagttgactgttcttcgtaatatgcttgcgaactgtaacagtgtgatactaaaggccggcctttgcaaccgatcaatctaacaattacttacacattaaataaatggatgtgatactaagtacttcagattaggaagacaactgtaatcatttataattagtactaaaggagataattcatgactctagccagacatggagtaccaaaaggatcctgcgattcaccatggtacaatagaccttttagatgctaccttaatacttcggaaaatactatggctaataaacgagcaatacctgcgtctaagacaacagcaactaaacctgtatctaaaagaccaaactctaaagtatcatccaaagctcctactagtaaacagggcgataccaaagctcctgctagtaaacagggcaataaaataagtagaggcgccaagtctaatactcggcataaacctgatacgagattgagagaaactggtgttcctgaacagatggcatcatccactcaattatccactcgtacagtagatccattcgctgaacctatgtctaccgattttccacaagttgtggatttagtaacatacagcgctcattttcaaccagcaggagatatactaggtagtgactctatcgctaacaagtattttcaatctgcgaaagggcaacagtggttaaccgacgtagctcaagcctatcgacgtgcaccagcagttcctttcaccgtagaccaactggttgtttatattaatactgtggcaggagcctacagtttcatgatagctactcgagaacatatgagatattgctattggtctaaaggtaaacaaaatcttactgatagactaggcttaatctttagttccgatattcgtgacgctcacttaaagttagcagacgaactatcctctcatttcttaccgcctaaggtaattccattattagataaattgcacggtatatatactactggtattagtactgatgctccagactttcagattgtgccttggacagaagggtttaacactgatagtgattttgtcaatacttttgacgctcatctagcagccctcagagccatacccaacttaactgcgttaagaggcgcttttgcatctaatttatatgataatgtagctgttccaatggaacagttgaatatgacaaatgatttcaagaatcctgataattacttatctccagaaatgggtgaagtaacttatgatcctgaaatgttaaccatctggtcgaatttacccttatatacatacacagctggtgctgtacaagcttataaagtggctactacattagtttctgtatctataccttatgtaggtaaaggggtaacatcattaaccacagccactaaagctgtatatgttacggcaaatagccgatttgaaccaggcctattagtgcccatgctagttcctaccgtaaatggtgagaataattttaaatacattaataattctggtgtagaaacagaagttgatgctagtgctggacaagttgattcactaatattaggcattgcagcacgcaatgttgaaaatgtttatgctgaagcttctttaggtagaaccattccatcaggcttctctcattcttattcgaatgtcagaaacataggttatgattcttatgaatttatgacagatatattgtcataagctgtagggggacttctgtctccc

SEQ ID NO: 254 - DNA, 1656 bp, Unknown
  derived from dsRNAs of unknown virus
agtaatttattacattttcaattcattgaagcgtataattactggttgctacgattatgtcagagatgtataaagtaggaaatctagcaatgggatttcggaatctaaccctaagtcattgcaacgacaacgattcattgttgttttacagcacgcgaagtctgtatcttttagatgcacgacatgcgccaacattgtagctattttagctgcaaatgaggatttggccattgtgcccacatttttgaggtggcttagtcaatgaatcctgataacccagagcactactacgagccctgtgaacgtattagttattgcactgcgtgcgataacctccaaattggacacctttacaggatgagaagatgggattctgacggtggtacgtcaattgttcgcaaatttatttgtgatggttgcgtttctgttgatattgaccatgaatgtatcattcaactttctgaacaggaagatgaacttgttacagagttcaaacgaattgccagagaggtctttcaacgcgcacacgatgaacgtactagcataactcaagttagtatcgagttttatcaaactagtcttgatgactggaactttgatgaacatgatcctgacttttgttcagtatgtgatccagaggagtgtcgttatgcgtagtaacaaccatctctaccattcaaacctaatgccggtaacattagttaataactgtgatcacagtttgacgagaggaaagactctaggagaaaaactatgcatgatagtgaattaaatccaaatactgaatctgttgaggtaaagcctgaacagaaagacacgatgaagaagcaattcgaatatccgtttttctatagtaagaagaacgaagacgaagaagcacttcgggaacgatttctcgaaagttactcaaatatcgatgattatgagtatcaagaatcagacgatttccccaatggagcgtctttggtgagaaagcaaaagaaagctagcagtagcgaagccaactacgttaaggaaggtgttgacagcatcactgacaacgttgaggtggaaagttcagcataggtctctggtgattagctttgcaagagatcaagttgagagataacgaactagtttcgtacgttactaactcagtcacatgtagtatgaaacctactactgataggtgttactatgtctgacgtggctttcgaattttcttttatggaagtagccataatggtgggaatgtatttcctttggacattattaaattcgtttaatgataaaagaggttttgcagcaccagcgtctcgcatcgatatggcgcgtgacatttctaacttgttagttggtcatgctttacagattatcgacagactagacggaagaagagacggaaaagtagcaggactacctatacctgctgaattagagatcgttaaacgtggcgttgtcgaagaacttatttctaagttcggaccaatgcttttaagcttaatgactgagcctgttccaaaacaagatgaggaacctgaggatgtgcaaatctagggttactcgcgggtgaccaaagctctgtagaagaactaacggttgttcacttggacaggtgaatacaaatgggaaaggaacgataaatgtccaaacaaaaggcgttcatctccctacccc

SEQ ID NO: 255 - DNA, 1626 bp, Unknown
  derived from dsRNAs of unknown virus
gttaaattaaataaactaataaacaaattaaataaaatgttaacaatcaaattcgagacaaatatctcagaatacaggagagaaagcagctgtactagcacagttccatgctgggagaaaggccaccatagtattaggcagtcttggatagaaattggaggattgagctatggcgaaacgtaatttcggagcactgataggagagctagtcctagatgaagtgttatgtaaagaaggctcactttgcaatcaactacaaaaccgggagattaacatggctaataaaattagaccaaaacccgagactaaggcccatgaacctaaagtcaagactaacaggaaatctctgtcaagaggtaaagcatctaaaggaaacaccaaacctcgaggattcaacaaatccactatgagtgaagatgttgatgtaaaaatacctgaagttgtcaacaactcaagagtgacttatccttactctagagtcagaacttcggtatatcctcaattcgctgacttgttccattatggaatggctgtctatccagctggtgatgctgttggatcagattcttttgcaagaaaccattatcaagcagtgatcggccctaaattactagcggccatacgaaactcacttacatatggtcccgcttcagcaattacgattgatgaaacagcagactatataaatgaagtatcgaatgcatactttcatttggtgtctattcgtaatctctaccgatacgcattccattctcgtagacgtgctgacataggtttatactttgatctcatttatgatgagactgtcccacctgctcacgctagattagctaatgcattaggacaaatgtatttacctcctgcagttaagtcgtatatcgacacaattgctgggatttatgctactgatgatactccaaatgcaactaattatcagatagtgccttacacatcaggctttaataatgcagccgcgtttgttgcagcttacgcagttcaaactgccgcagttgagaatgtaactaaacggattgatatgaacactgcgtttaatagcccaagatttcaatccgacttcattagtatggaacccattgttgttgattcacatcgtaacccagacaatttcttgactgatacgtatgagccaacatacaattccgctatgattgacatatggacgaatctacctttagaaggttctgtgatagctgaagttgttcgttaccccgttactgatactgttgagactattaatgatgcttcttttggagctgaatactctaaattgtcacaacacagttcgagtaaatatgtcacttcactgtctcgctttgaacctggaattttaattccaagcacagctgttgccccaggctcagtcaatagcaatatgagagtagtgacgtcaactggtgactctgtctttgatttctccaatattagttttcactattatggaattctctccagaaatgttgagaattgttatcatgcagatgcagatcgtaagatcatgccagctggcgctaaggtaagtttaactactatggagcataaagcttccgatacatatgatgtgatggatgctatgtttagttaattatcgggaccctttggggtccc

SEQ ID NO: 256 - DNA, 1660 bp, Unknown
  derived from dsRNAs of unknown virus
gtaaaataaattatcgaggaatattttatagaagagaggaagattctattatgacaaatgatgacgttattaaaaccattgacgcagctctggcagtcactagtcttctatcgcccgcttcagtattggtgagaaaagccgtcgtgccatatttaattcgacgtcactttaaaaccagagcagcgagatggtctgtgagtaaatctccggaaacaatgaatgaaagtatagctaggcaggtcagatatcgcgctagtcagggactacgtgctgttggttctcagaaaactgagttcctaggtgatgcagcatccgtggctaggtctggtctacaattttctgcgcctccaggtaattcaactaatcctggaaactcggccttaactaataatcctatagtaaataaggagtctatcatgacagagaaacgttccgtttctaaaactcgcggtcgtaaacgcggtcgcacagtggaatcagagtcttcaactggtttcggtggtagtggtttattatcaaacagcgtgggttacgtaaatccgtatctttttgattctcagaaatacgtcccattaatgattagttatcatgacattaatccaacaggtcattatgaatctgattatatttcacagcaatttcaagatgtgattttcacttcttacgatgctgcattcagacgtgctgttagatttaatgcaggatttgattattctaatctaatactccatcttaatgccactcttggtttgttacgttattactacgctacagtgggtataatgttctacgctagtacagttaacaatagagcagctagttctttaatgcaagatttcctctcaccggaaattcagaatgctcttttgaaaacagaaagtactttggcaactttaggtttacctcctaaattgcaagaattagcgtactacacaagtatgccttttgtaattgataaagttgaaggtgcggtacgtatgcatatcgcaaaaggtttagccttcgatggttctggtttagctgggtctcttgaagcacagattgataatgtagctactacaagtcaattaattgaaagtgcaaaattgattcaattaggtaagatgttaggtgaaaactggagcatcacacttaaagagccaggtattttagatacatcaagtgcgtggggtagattctctgcaaatatgtggatcaatagagctacataccaatcacaagcaggtgatccaccaacaatagcgtacaaaccagctgttgataatgaaactatttcagtaccatactattcaattgatgataaatttacgtcatatgattcagtatttcaatcagtttggatggaaacaccagacttttggttacctggtatggtcactgctgatgatggatttgctgttccgaattcaaacgatgtattgtattggaatcctgatacaaatggatttagtgcagtgaatgatggttacgaagccgtactagcttcaactcgtcatccgtatttcaattggaattacaacgttgtgtcaagaactcaagtatttgagaactctttgaataacgcacaactgttcgttcctgaagttatggatgatctatactcagtatcttcagtaaataaagtatcttaattgatacggatgacgcgaccgcgtcatcc

SEQ ID NO: 257 - DNA, 1651 bp, Unknown
  derived from dsRNAs of unknown virus
gtaaataataatcaaagtgatgtactgatcttactttaccggtgcgtggccttaaatcatcaaaacaaatgtatcagatatatgtctgaccgagaggtgcacccactcctctaacccaaatattatatgagaaagtcaatccgcgaagaacttacaagtcttggtgtatctgaagatgccttgttcaagctttcccgattgctcgatagaacggtaactggatatgacgaagtgttgttatctccaatagcaagtagagtcaatccggaagaaatcctttcaggttgggacgaaatattcaattctaatcgaggaaaactcaatgatgttttactcgagttggagcagtcaaatcgttctaaatacggtcccagatctatcgcagttccttgggatgaacgtaagtctggagttgataataccttttcccctgacagcggaaaagagattgaatcctacactccagataacgggaggttgcgacctatatctctcctgaatgcagccaaatacattaagaagcaaacaaatgcaggtctaccttctatgtctaagaaaggtaatgttttaagtgatactcttaatgatattgataatcaattagataagaattatccaagtgtaccttttactagaactcaagagaataagaaaactcgtcttgtttggggataccctctatcagctgtcgtcgatgagatgagattctatagacctattcttgagtatcagagaaatttaccttggcgtgcagcattaaggtcggcagacgacatcgacgttgccctgtctaaactcatcaaccatgctcagagtcaaggaaagagtctagtgagtatagacttttctaattttgacaattctgttaaaagaaagcttcaggattatgccttcaacgtgtattttaatagtctatttcaaaccaaatatcaccctgaaatagctaaacactttgaaagatttaacactattggactggttacccctgaccgcatttacaaaggtccacatggcattccttcaggttcagcttacacgaatgaagtaggatctgttgttcagtatggtatttcacaaacattcgatgaagatttggattcttctcaggtccagggtgacgacggtgcatacgctacctttgatcccgaaggttttaaagatcacttccgctcgtacggacttgatgtaaatgatgagaaatcttatatttctgacaattttgtaatatacctacaaaatttgtatcatacagattataaagataaaggtattattcgtggagtctatcctacgtacagagctttacttaggatagtttatcaagagagattcaatgacttttcaaaggatgatatatcaggaaaggattactatgcgataagaacactttccatattagaaaatgtaaagcaccatcctttatttgaagagtttgtaaaatatattgtcaaactagataaatataatttacaagttagcgaccaaggcatttcatcgtatatcaagatgcgtgaaaagcaagatggtaaagactttaaatttactgaatataagagaggggatggatttggtataaaatcttttgcttcttataaattagctaataagtttagagtaaaataatttcggtggaacactttcgtgctccatc

SEQ ID NO: 258 - DNA, 1597 bp, Unknown
  derived from dsRNAs of unknown virus
agtaatttattacatattcaatttctttgaagtatgaattacaggacgttaattttatgaggaaattatataaattaagaagtctagcaatgggatttagatggttatctttaacgcattgcaacgatgatggttcattcgataatgtaaacatcattcaaaatgagaagtccgtaacttttgtttgcgcgacatgctccaccaccgttggcgtactccaagtacctagaggaggttatacgtaatgtctaatagccaaggtcccacatcagattgcgaatacgtttcggcatgttcctattgtgataatatgcaaagaggtcatcaatatcattttgagaatgacatgggtcaatacggatacatatttatatgtttaggctgtttgcccccatccaccaaaattgattattatgaacacgactgtattagtgaaatcatagacgacgaggttccacatagtgaaggttgtccttacggcatgagctggtccgaaattttcgaaatgtataaaaccgaaaatttcgatatcatcgtacgcggtaagtgcgagcgacctagttgtcctgatccatacaggaggtgggtgtcttaacatgtgttttgactctgaaaataatttaaacctaatgccggtaacattagttaatgactgtaattacagtttgacgagaggaaagactctaggagataaactatgcacgatagtgaattagaaccaaacacaacggaagctgttgaggctaagcctgaacagaagacaagtacgaagaatttcgttcataagtttttctatgcaaagaaaaacgaatctgaagaagaagttcgggaacgatttctcgaaagttattcaaatatcgaagattttgaatacatcgaatccgacgaataccccaatggtgcggctttggtgagaaaacaaaagaaagctagcagtagcgaagccgactacaagaaagaaagtgttgacaccgctgtttcgaatgttgaggtggaaagttcgacataggtctctggtgattagctttgcaagagatcaagttgagagataacgaactaggttcgtacgttactaactcggtcatatgtagtatgaaacctactactgataggtgttactatgtctgacgtggctttcgaattctcttttatggaggtagccataatggttggaatgtatttcctttggacattgttaaattcatttaacgataaaagaggttttgcagcaccagcatctcgtattgatatggcgcgtgatatatctaacctacttgttagtcatgcgattaccattattgatcgtttagatggaaagagagacggtaagatagcgggcgtacccatatccgctgaattagaagtcgttaaacgtggtgtaatcgaagatctgattaaacagttcggaccaatgctattaagtttaatgacggagcctattcctgaaaatgaggaacctgaggacgttcaagtctagggttactcgcgggtgaccaaagctctgtagaagaactaacggttattcattcggacaggtgaatataaatgggaaaggaacgataaatgtccaaataaaaggcgttcatctccctacccc

SEQ ID NO: 259 - DNA, 1568 bp, Unknown
  derived from dsRNAs of unknown virus
agaaattttatatggtagacttataacctacagattatgatttttctttaacactttcaaaaacagttttatcgaatgccccctgttattgttagtgcccgccggaaggcgggactgttttaactatgggcgttcgatattaaataaactgttatgaaagatgttgattttggaatttattccgaagattttattaaagagttaaccaactttttaaaaattgtcaaacaaattcaaaaaactcattatggaataggttccactgctgtggattattctatgattagacttaatgattgcagatctttttcgacctcgcttttaaagctgatgtctggtgttccctcagtatttgatcctggaagtgacgccgctggagtagtctctcctgccgctgatataattttaaaaattgtttttgaatcagtgggtagagaaatggctactcatgtgtgccgtatgactttctcagattataatgcttgtagaggaacggtaggattacccgctttgcgttggatcgatattgaggtagccggtgagttctttagagctcctcatcctcatgatagagattatggcgataattttgtcgatgtagtgagaaacttaatttcagtccaaattcctgacttatgtaatttacttatgcaagctttggtgaaagaggacaaattgagagaattagtgagagattttacaaattaaatgaaagactgttatgaaagaaaagattaatgttccgtcctccaacttcttcgttggaatttattatcatgctaaagcaggtgttcttacttgctacttatggttattacgattgaaaacttacctccttcataggattaaattcctatggcttgcggttctccatcacgagtttcgcgaaccaggggtcctctcaatgaagagtgagtttaatggtgctaagcacgttcaagttcccatttctttggagtttgtctataataaagggattcatattcggaccgttcaagtgtacgttcgacctaatgatattcctgtttctaggcatgacttcttaagtttaggcgcttccattctcccctctcttttagagatctgtcctgaaatttcaagatggaaattaagaagagtagagcagaccatctggtctagatctcttaggcgaatgtcgactactatgtccgattatactttctattacttacaattctttactccttttgggaagtttagaattatggatagaatggtatctatggatattgttgatcaaagtgcagagactattcatgtaaatcatattatgaagtaaccttattgattagtaaattatggataaatatagagtttattttttctcctaacaaaggcaaagttcctggtaactatgccattgatgatagaaatggtcgtcatggcttattctattttatatttcttaaaactaaggatagaactccctcagatcttattagatcgatggagtatattcttagatctaagagccccaatttgtctctacgatattttggacaagttcattagagagacttaccaacttctatggaagttggtttccc

SEQ ID NO: 260 - DNA, 1580 bp, Unknown
  derived from dsRNAs of unknown virus
gggaaaatctttccatgaaaagtgttgatgacctcgatgaaagaagttgttacagccctagtggacaaatgtgattggaaaggcccacctcgaccaaagctacgtgcatgtgcttcctcccgaggtgggctcccgactaatgtgaggataggcacaagcacaggaggaacacgaatgacagtaatgttaatgcgtttgtacagtaccgcactccgaaattgtacaccaaccgccgccgaatgccaggcccagagaggtgagactgatgaagtacgcctatcctgaggtacctgagagagtgccacccgcacgcaagcacgggaccaaactaggtcctaagattgcagctggatggttcagagacccagcagttaagatgtcgaactgtccgttttgtcgggcaaagtacacagcttacgaagctgttcaagctgacctacacaaagtgtatgtcggacagtccaaacatggactagcgtctaagtacgttttagtcgaaacagtagttcgtaacacaaacaacagggttagaccagtgttcgcccgtacgcgcaagcatgcgtgcatgaatgagcgctgtgaccaccacatctcagtagaccagaggatggacgaggatgggaaactactctccatgctgaaaagaagcatctatctgaacaaaggcaagaagcggtctcgtaaagcaaggaggcaggcacgatgaagtttacacctactggtgaaaaccattacgcttcgttcggggctacggatcatccatacgttggtatggtgcatttcgagcctcagttcgagcaatatcgggtaagtctctggcgcttcggcgaatgtctagacgtgttacacgtcgatgactacctcactgctatggttgtagcagcacaagcagtctacagcgatgacgttgaagacagcttttcccctgaatttgtggagaagttgcaatgaacgacgaagtcatgcctataggcattacaactaccgttgctctacgtaaattgcgcaccgtaatggccatgctggacaagtttccagacgaaggcgattgctggtgtactgccaccgttgaccatatgagttgggagctcagttctgttgaagaacagattcttaagctatcagctctattgatggtggaggaggaataaatgcaatggcatttgtatacttcagcaattcgtggcgcggtaacagttgggctgccaagctacgacaaggcgatacgaaacctgttttctggacgaaaaacgaggacgccatttctgatcagattgatgctgattggaaagcgtacgacgaaaagttctccggaagaggaatgagaatcgcttacgatgtatttacgaccaaagaggatgtgctccgagagtacaaattctttataaataaatacaaaagtgaggctgaggcgcacgtatggatacaaggcactcttgatggactaggtcctgacaggatgctgcgttacctgcgagcgaacggcaagagggcttaagttagtcctgtgattgtctcacgaagaagctctgaggagctacgtaacgtcccgtgtgggggaaactaaacaaaccacaccc

SEQ ID NO: 261 - DNA, 1551 bp, Unknown
  derived from dsRNAs of unknown virus
tagcggtgctgctagtattggcggaactattgctgccacacgggttgcctttggtacaggtaccgacgagataggtggcgatgcccactttacttacgataacgtagctaaccaacttagaattgtcggcgcaaacgacgctaatgctgagtttattattgaacgtactgctggaaacgtccagaagatcggtattgaaaatgactcttcagagtcacctaagatgagggttgaatcagctggtactaatacaaagtttatgtctttctttaataccatagcggagtcttcagtttctgctgggctttcaggattcaagtttaacacccaaacgggtggtaataccggtacaattaaggaattactaagtatgcatactggtgacagtgtgcaattcgaggtagtctttaacgaagacggtgcaaaccaagacttcaggattgagtctgacggtaattcgaacatgttcgtattagatgggtctcaaaacaaccttggtattggaggtgcacctgcaagtactgtagaaagagttcatattatcgggagtagtgatgacgtatttacgccgctcgttaggttacaaaccaataacaacgatgcggacactgcacctatattagagttcttccgtaattctacttcaatcgaagcaggtaaccaattaggtatgctgagattctctggtaacaatactagtggaagtaaagaaacttacggttctataaacgttcagattgattctggcgcttcaagtgactcaacatctatgcaatttaaggtgaagaggtcaggtgtgcaaagtgataacttcaggataaggtattctgaggttgttgttaacgaagactcgaccgattgtgactttagagttgaaactaacgctaatactcacttcttccatgttgacgctgcaaacgatatcgttggtgtaggggccataggcgtttccacgaacgatgctattcttcaagtgaatggcggtatgtcagcttcagctgcaattgaaggtctagttagggttgtaaatgtcactggtgacattaaccttggcgatgacttctcggcagtcggcggacagtattacgtgaatgttacaggatcagaacaagaactagtgctacctaacggtgcacaggttggttcaagattttcgttctctgtaggttcatctggtagcaacataaaagttgtagcacaaccaggacacaccgttaatggtgcgtcagacgtaacacgttcagttgttaatgatgttaactggtgtactttgtacgccagagatggatcaggtaataactcatggatagtggggaatgcttaatgtctgatacagtaaatattgaaatttcagaagatgagattagaatcggagaatattaccttaagggtaagattccagacaagttggcttggatagtcctagctgctatcgcagcagcatgcggactaaactatgagcaacttatgtcatttgcaggcggcttctgagaagtcgtcgaactcgaccagcacttggtggtaatggtcgttttaataaatccaccaccc

SEQ ID NO: 262 - DNA, 1575 bp, Unknown
  derived from dsRNAs of unknown virus
gttttaaaaggccacatatgctcaaagcatcgacctatactgacaacgtgaagcagttcatcggctggatggacaggctgagcgaagccgtcactgaggactatcgcagtccgctatttggcgagcttactcggaaacaagtgtttcaagagtatttacgaaatgtgccattggaaggtccgaaattttcggagcacatgagtgaacgtgaacgcaaggaagcagaacgcatccttaccccatggtcagagcgacctccctggtctgcatggggaccacaaacggtagcaagttactacgcaccaaaggatccaccccttaatacgttagaaacggcgacctcccgactcaagcagaaacttggttcgggtccaggccaaccatggccactaaagaaggcttaccaccaactcccatccacgacaagctcaggactcgattggcttgtaacaccgtggaagaaggaggtaggttctgaggttttacgcatagtagaatcagcatgggcgaatgacgatccaatcgacattcccccgtccatgcccatgtggagagtcgatcctccaggaaaggttcgattcgcatgggcggagtcaaagatagaagcagtagccggagccccgttcgtctatccactaatcgctgactggagagagatcccggaattcgtagcttggaaaggtccaaactacgctcaacctatggtttcagaaactttacagactcaccctggaaatgttctgtcaatagactatagtacgttcgatcaaactcaaagtcccaaattgatacgtcatgcttgcgacatcatgcatgaagcgtgtggataccgcaaaccgaatttctttaaatcatgggtagacaaccttgtccaaggacctgtcctcacccctgatcgcgagttaaccgggtaccacggcataccgtcaggttcggtggcaacgaatatggtagacactataaataacatgctttgtatcgagggatatcttgattcttacggtatcgatggagtgtacttcgcactcggggatgatgctgtaataatcggtgaaggcgttgaccctgtagacttcgctgaatttgcaactggagactttggttttgtcgctaatcccgacaagcaattcttcagcacaagtaaagctgccgactttctccaaatgtcgtattatgttgagaacggatacaagccaacatatcccgtctcgcgcgtagcctggcggatgattgggtacgaaagacatcggtatcgtgggaaggactggaatgaatggggcgttgttgtcagaactttacaacagcttcagaatgcaatcaacaatccaagcatcgataagatggttgaatggattcaacgcgacggagatagactaagactcggagccgatgaggatcctcaagaaattttggaactcgcaggcaaacccgctaaagcaatgacggaggaaagagcacgatgggacccgggagccgaagagtctcgtccattccgcgaatgggagataaacaagctggtgcgaaggttggctcgaaggcgatagccgacaaccggttgaggtattcctcaacccc

SEQ ID NO: 263 - DNA, 1462 bp, Unknown
  derived from dsRNAs of unknown virus
aaaaatttaattaataatcgtatacaatgaaaattgtaactgaaagaagtcatgcagaactttggaaggttcgtattgatttgccgactacacctacagtcgattacccactaaattaggaaatatatatcatgcgtaagaaatctacattccgtaaagtagcagatacagctggtaaagttgagatagtagctaaaggtgtgaagaacactgctagtgaactagacaactcatatggtaatgatggacacagagccactcgaagtgcacgcccttcaggtgtcatagtcagagctagggattcaattctccctgacatcggtgctcgtatatttgtagacccacttgatgatgagaaaacttttatcgtacaaggtatatctgtcaatattggtgatcccgaaaccggttccatagctgccacttacatacgagattatgtatatccggcgtataataatgctatcattcaaggtgttaagtatgatacttcaggtataattactcaagctaaattagctgcgtatcataaacacattttgtctgcgttagccgcttattatttcgtttcgtatcagaaagcgtttatctctgactctactaatgtaagctcttcgcttaatgctagagacgtcaatgtttacggtcctgcgaccgaagaagcattaaaagtgatgcgtaatagattgcaaagttattgtgttagtccgaatatgattaagttgatggattggttattccaacttcgtccttcttcacgtactcctaacgctaatttgttgcaattttgtgatgatactaacttgatcactgctactgatgatgatacattatcggtatatcttcgtcagaaattaatagatctagacgatgatgatggtcgagtatctagtacactaggtaaagttcaaccggattggcaaattcgattgcaacattactctgaaatgaattctaatccttcaatggatttcaattggcttaatatatggatgaactttggtgttgaaagacctgctcctattgataatctaccttacaatagtatgaaatacgtcttaagcaacgataatccaaatgcaatctgtactgctctagccactatctatgattcaactaatttagtttgggatccaggattagtggaacctaaaacagcaatcactactaatgtgtacattgctaattctgttactggtgctatgagtgatttggttcaaaccagcagtagattattaggttcatggagatattatgactacgtaaatggtactacaccaatagatatagttgaagctatgcccgagagcgcatcagtggaaatcaatgctattgatcttaagccagacactcagtctatgctgaaattcttgtataatttagatactatacaaaattctggaataagtgctatgaagaatctagtgactagataatgctagtggggaaactaagtttcccc

SEQ ID NO: 264 - DNA, 1517 bp, Unknown
  derived from dsRNAs of unknown virus
agttgatactgacgatgaactagtacgaaatgcacgcccgtatcttaaatccgttgaggaaggtaaagacagtgatatacgtactcctctattcgatggtagatccagagaagagatcacagaagaatgggcttctatacttttccaatatgatttgcttccagagcaccttgaagtggagactaagtcaatgggtcatattggtccgctctcgcagagacttccattcgctgagagacgttcgggagtaacatcttactatgattcattcattgagcctcgaaaagaaatttctgcgttaccgagtataaacaaggtattgagtagacgctctaggctgataccgttatcatactcgacatccgctcgcggattgcccttgaacacgaactccggtctctccctattccagagaaggtctaaagtgattgatcaggaactcagtgttgcccgcactgatagtgtgctaccctgtgtgttgggctggagaggtcaatctagtggcagtaaaattccgaaacagcgtgtagtttggatgttcccgatgtcccaaaacataagggaaaaccggtttttcaggccgctgcatgaagtcctcaagcgcctagagagttttagtgcatggatctctatggacgctgttgacgatagtgtaacccggctactcgctaggcgtgatactgttggaggtaccatactatcttccgacttctcaaaatttgaccagactatgggccctgctcaactgaaatggtactttaatctgttacgcaacgtctatgacgtcaaatttcacgaagatatcgatttcctacagtatgtattggcatatattcctttagtgtgtacgcttgatgaaacgtttattggagtacacggttggggttcaggttcaaacctaactaatcaagcggatagcgtagtgaatcatcacgctcaaatcacctcgatggaagtccctgaagaaggtataattttagtccaaggcgatgacgctgcattgaacgtctatgatgttgaccggcatctgactcacctgtctgatcttgggtttgaggctaatgctagtaaacagtatatctctgatactgtggtccattatttgcaacgtgtacactcggctaattataaggtgaacggtagagctgtcggcgtatatcccacaatgcgagcgcttaactcgttgatgggtcaggagaggtttcacgatgattggagttccgttatggtgagtttgagaacattgtctattctcgaaaacgtcagaaatcatccaatctttactcggtttgtgaaatacattatggaaaaaggcgataaatcattgaaagagaacaccgccaggatcgtgaaggatcggtcgtatattaagcgagctaaggccattccaggattcttacctagctacaatgaagctggtaaacttgatgggattcgtaggtttaagagcgtacgcctcattctagaatcttaagctggtctgcataacgtgtcgcgtggtctcacccacgttatgc

SEQ ID NO: 265 - DNA, 1509 bp, Unknown
  derived from dsRNAs of unknown virus
gggattttaagtttaattgtgagccaacatgcagaccagggtgtattctagggatggacctatgttggatattcggttgtcagacttcactacagtcaaggaaagaaatgttttgctagagtatgacgcattggtggggaaaataaggtatgctctgtatcctatgttgattaactcattgagagacgtctactctgatgtgaccacgaagaccgcctttgctagaatagttggttgtatgaatgattacaacattatacccaaaggacttgagcagctgttgaatttcatcaagcgcggaattcaggtcggtgacgagctagtgcgttatgattctggaaaagatgtgagcgttgctgcctataagctgttgtttggtatgttcaagcgtgatgagtcacagcttcttgatgatctacatcataaatgcttccaacgttttgctaacaaggatggccatatctgcacacctttgtttactgtgatgagatcggagggagtgactgagtatcagaagggtaaggttaagctgagggttgagagattgggaagaggtgtgatgggcaagggcgtagtgtattgttacactcacgatggtggttttgatttctatgttgatgatacacaatacaggaccaatctcgcagccttcagtttgatcaactcagaggtggcgtatttgcagaagtatcgtaaggataaggagaaggccaggatgagggtacataaactgtgctacttcatgttctccgctccaaaggccaaaacaactagcacgcacttcataacagaagtagttttccaacacgctcggcttcactattcacgtgatagtgactccgtgacgtttgacgtgcctcatctcgacttatgcaaggatgagaatgtcagttacagcaagatgaccagcatgctgttgaagtactatatcatgcacatcttcggatggggtgtgaagtgtaacggatgccaactgaaggtacttaaacctttacctacgtctttgaacataccttcgcacgattttcctcttaccatggagcaaagggctgatgccatacgtacgagacgttctccttcaggtgcagaaaagcatgatgttgatgatgatagtgatgcggaaagtgatgatgatgtacgtgtggaaacttctgagcgtgctgccgcctctgctacttgtttagctgagaaagatagtgacacatatactcagttggggccacatggtattaaaactaataaacgttatcttcagcttaatgcagggagtaagggagataaggttccaaatgttgacacagcaacaaaagagccaacaactgaaactactcagtccgctgatgatacttcacctcaatcagaaagcagaactttggatcagaatgtgtctttcatatagaatgacgatgaccgtttccaacttcatccactagttgcacgcctgcgagtgtgtccgttgggtttcagcaatacccttcggatagtgctgcagttgaatgataacagacc

SEQ ID NO: 266 - DNA, 1515 bp, Unknown
  derived from dsRNAs of unknown virus
gaaactaaatcataataaaatgaggtgtttcgaaagaaatgtcaacaatctcgaatcgcaatagcgaattcgttaaaaggtttctgtctaaccttcaaatagacaacattggacgtattgaacgtaagttagcaccaaagttacggaaggaagtgttaccgcttgcccgaaaacttctccgtacatctagtataccgtcaggtctacaattccaggaagataaatacttagagcgcgttgagtggcctagatcgacctataagtactcagtacttgtagaacaatcaaacgctttcgcaaatgttcccccaggagatgaattattcattgacgataggtggagtcatccgtggaagcaaagcgcggctttcagttttgatctcagtttgggaaggaatcgtcgtagtctgccgaagggtggaagcctccctaatggagggtccaagagggataacctcgccgaggcggaattgtacaacgagcaaaagataaaacctaacccacatttggaaaactgttattcaatcatgccaggagttcggacccaacagtctcaccctgatgatcctaaagtcaggcttgtttggggcacgcccacccattggtggatgatagaatgtgaggcttttgacagcgcgttaacatatacaattgaagcggctggtaaagctgatactgatatattcgttttctacacggagcctagtaagcttcaagagtggacaaggaatcactacagttcagtaaatcagtgggttaaccttgatgcatcacaatttgatgcttctgtcactgcatctgagattaagcagatggtggagtacttttgcggaaactatgagttcaaagaacttgtgaaagagtacttggtaagtgcagccctggtcatgccggaaggcgatttaacgcgaagtggaggtcaaccgtctggatctaagacaacgaacctgttcgatggattctgtaatgtctttgatgttatagagtcgtttaagcgatacaaattggatcggtttatccagtgtatctgcgttaatggtgatgacattaccattggattggacactaagttaacgaaagacaatttagaaaagattagccaagctagtcgaaggaacattcatccagataagtcagttaccggtgaatatctgtggaattctaaattatatgtagacgagagtctcatgactagaccggtgtttagagtacttaattcattaatgttttccgaaaggatgaagtcttctgtgtacggctcaaaagaatacattgagatcgctactgcacaacagttgatggatattgaacagcatccattcggtcctgatataattaaggctgttgctggtatttccaaataccatataagtagcatgcccgatgagcaacttcaagaagctgctgaagcatatctagatgcccattcctggaaagaaggggaagtaagtgatatgctgtcaagtatcaggtcgagcacttacggacaaattggatcttaatcccaatttgttt

SEQ ID NO: 267 - DNA, 1490 bp, Unknown
  derived from dsRNAs of unknown virus
gtaaaaatttaactaaataacttgaagaatttaataatattagattcagcttaaagcaatcacgctttgacttggacgtcatatattgattagccgattgcacctgtagccaggtttatccacttaattatttatacatcatatacataggtaaaattatgagatccaaaggattcaaaaagacagctgaagtcgccggtaagatagaagtagtgtcaaaaggcgttaagaacacagcattggaattagatagcaaatacggaaatgatggtcatagagcgactagatcttcccgtcccgaaaacgtaatagttagggcacgtgactcggctttaccaaatattggtgccagagtatttgttgaccccttagatggtgagaaagcggtatatgcttgtccagtcattctaaagatgggtgatccagaaactggttcattagcttcaacttatgttagtgactatttgttccctgcttacgacaatgctattatgcaaggcgtgaagtatgatgtgtctggtttgtttgacgaatctaaatttcgtgcttaccatgatcatatcttaaaagcaatagccacgtattattttgtgtcattccaaagatctttctcttcagatccgaatttaaattcgagatcattcagtgtccgtgatgcaaatatctacggtcctggaacagaggaatctttgagagtattaagaaacagaattcaacaatattgtgttagtccgaatctagtcagtttaatgaaatggttgtttccaattcgttcagcaggtagaacacctaatgctaatttactacaattctgtcctgatacatctttgcttacagcagaagatgatgatgcaatttcaattattctaaggacaactatcagtgagctaacaagcgctgataataaagtatccagtttaattggtaagatccaacctgattggcaaatcaagttagatcattacacagatgtaaatgctaatcctgaagtagactttaattggtttaacgtatgggttaattttggaataggacgcgtagagcctgaagataatttaccttatgataatatggaatacgttttatataacgataatcctaatgccatctgtactactttgtctaccatatatgattctactaatacagtctgggatccaggtttaattacaccaataactagtttatctactggtacctacattattgatgatagtactggtatgtatattgccttagccgctacaagcgaacgtattttaggagcacaacgctactatgaatatgaacaaggcactacacctattgatgtaataacagctatacctgagtctacagcagtagtttctaatgcaatagatactaaacctgacgttcaatcgatcatgaagtatttatttaatttagaagtcatacaaaacaatggtttgtctagcatgagaaatctagttaaaagataagatgtaagaagtgggagagttaaatctccc

SEQ ID NO: 268 - DNA, 1488 bp, Unknown
  derived from dsRNAs of unknown virus
gtaaaattttaaactaattagtaatgatcattcattttaaatgttgagaagaagtcacgtaggtgatttggaattcacattgtaactaccgactacacctgtcaacagctagatgtatcaacctaacttggaatacaaccataccattatgcgcaagtatcctaaaaccaagcgtgtgctagataaggcatccgaaatagcaggcgaagtagagactgttgccgggtcaattagaactggagcagaagccgctagtaagaagctgggtaacgataaacatagagccactcgtgctgcacgtccacgtgatgtaatagtcagatctagaaattctgcattaccagatatagcttcgagagctttcgttgaccctttaaattcttttagattctgggcaggacaagtcaccgattttgatcctactggagtctcagctggttcaatcgtatctgatcgttttgacgattatgtatttaccagttatctgacggccataattcaagccgttaagttcgatatatcaggaacattcactaatgctaatttatcagcttacttcctatgtatgactaacgtattacgtgactattacgtattagcgtatcaacgtaactggatgttagatgctgatgtaattggaactgcattgtataaacgtaatgaagttcaatatggtgaagcagtagaatctcaattacgagttgctaaacatatgttagatcaattcgttctaccaccagctttacatgaaatgattaaatggtactcagcgatttatccattgactagaggtcctagtggtaacgtagttcaattcatgcgtgatacttataccactgcggatactgacgctgatgttgctgcagctttgaagacacaagtatcttcaattacgactactgataaaattatctctagttacctcggaaaagcttttccaagctggagacttaaagttacagagtactatgacttaaccactaaccctgagttagatttcaattatttgaatatttggtataatcaaggtaaactatctactgtaccagcagaaaacttacctactgattctgtaaattacgtcttgtttaatgacaatccgaatgtaatgtgcacagcattgagtactatttatgattcatctggtgcaatttgggaacctggtttcatagaaccgtatggcactaatctcaattcgagtatttggttctataatgcaaccacaggaaataacactgtgatcacaagagctgatccagcgctgctagccattaacaggcatatggactttgatgatgtagattcagcctatacttctgctattccacaacctaaagctgtgagtatgacacctggtgatttaaaagcggatgcaacatctgctttattgtacttattccatgtagatgaagtagaatcattatctcgacaatcttcctctggatacagataaagaatcttctgattcgggtatagtttactataccc

SEQ ID NO: 269 - DNA, 1476 bp, Unknown
  derived from dsRNAs of unknown virus
gggaaaaactcctcctgcagtttttagttcattctgcttctccgaggagtttttgcctaacacactccccctggttaagttatttcctttcttcgccagggggggctgcccattctgcggggcaatcggtacggcgattgaagatgaatggatccagcccaagacaaaaagcgctaatgtagtgacaacccccggacacaatggcgacggcccactggttaaaggcaggaaaacgtaggctacgccgtacagtagccgaaactaataagtgataagtgataaaatggataaggaatataactttattgatgccatgctattgactgaggctctggacgggctgttctctactgatgagaaggaagcgtcccatatctgtgatgtagttgagagactgcttggtggttacaacctccaaactagtgtatctctcgacatcgatcgcgaaactttgatgttagcttacattggtaagattgtttcagagttagcgaaagaaacttcattctggcagaataagtctattgacgaagaatatcatagactgaaggctgagaaacgcctattccagagcaggtctgataaccacggtgatttcgaatgagacgctgcaggaaatgcggttcatccgaactgatcccgatcagtcccgcccgtgtcgaagtagttaatacttcctcgggcgaggacattacgtatactgaatttgatttagtgtgcatggattgtggagcagctcacctggaggcgtacgtttaatggcagtagaaatactgtgtgctaaatgtaaagagtggacccagcatgccgattggtatggtagggtaagccactgcaagtggtgttggttcgaggtgttgaacgttgagtgaggtgaaggaagttgacaattatgttagacccaagcctaaaccaactggtctacgcccaggattttatcatttggagaaatggactggcactaaatgtgtggtcggcaattgcaagggatccgatatacgtgtatcttttgtacaagtcgatgctgatgatcgctttcatcagttaaccgctctccaatcaaacaaaaggtcaaaacctgctgtttgcactattggatattcgttttgcaataatccaaagtgtgttagacacgtccgattaggcacaagaaaacttgatgacagtgagtcactggttaagcagctgaaagctaatcattggaaacgccaacagaagaataagaggaggagtaaccataacggaaaacgtagacgataggactcgtattgagttaacacgtgaatatttctatcagactcaaatcgatagattatcacgtcagttacagatcgtaactcagcagcttcatgaaaaagaagccgcatgcactggttgtcaagaagacgaatagtgtacttccctatgtgggaacacgggacctcctgggtgaggaacgtaaggagattgcaggactccgagtcaaaaactgcaccc

SEQ ID NO: 270 - DNA, 1451 bp, Unknown
  derived from dsRNAs of unknown virus
tacgagtctttgactaaagaacagtggacacagacgtatataccgcagttactaccaatggcacacacaattgccagtacttctgagttggacgactcgaagtcggtctggtccgagggtatttataccttattcggacgtacgccgaatcgaccagtccacggtgtttcggcgctacagaagatggttggagccaaggtgaactacgacttgactagagggctaggtgacggtaaatacccgcacatggcttggatgagcttagatctaatgtttcaaaggatggccaccccaatgggtgaggtcgagtgtactatacacgaagacttcaagtggttcgacgcttttgtagggaccgaaatcgcacaatgtgtgtacgacggtttcaaagaaagtcagttctaccgtgaccagcctgagaacaggaacatcttaaagtacttgttacgtgagcttaccacgcctacgtggattagaatttcacctaattcattgttaaagatgaaggccgggttgtattcaggtacgcctgttacgcaactattcggttccgtagttcacggtgcctacctcgagttgctgcgcgccgatcgcggtgtcgggatcacagattactgtgtcctgtccgacgacggtatgtgcacattcgaaggcacaaaggaagaagggctaaaggccgtaaacaacgaattcgttggcctagctgaggagatcgggatgaaaatctcgcctcagaagagttatgtcgctggcatcagggattacaaaacaatgtattccgctgccgacggcacaacgatcaagcgccacgatgttgggcctttcctacaaaagtacattcaggtggacgaccctctcggacatagtttcgggaacgtcccaagactgattgcatctttgaagggtagggagagagatttcgaacgcgaatctcaccagttactggtgagtttgcttccaggattaagacaagctaacagaggcgaccgttcaaccctcgtagcatgggttcccgatatgcatcggaccctagaggtgctcgcacaagttaggccagggtatccacgcgtacacgaactagttcgtggtgttgtaagtgtctacccacaatttgagaatagatttaataggctagtcgataacgctaaagccactggaggggtgctgtttgataccgcaacaccaaggccgggcggtgctagcgataaggggaccatgcggtggttggtagagtacttggagacttattattctactggtaagtttcccagatctggagagtaagtactctttactacgggttcagttaaatctattgtttaggatcagattagtgcgaaagcatgattcacaattacatacataagtcaatgcgctgaggatactcacaactcacaagtcgcggccgctgctcgggacgagagcgtggaattcgtgggctcacgcccccc

SEQ ID NO: 271 - DNA, 1446 bp, Unknown
  derived from dsRNAs of unknown virus
gaaacacggtgtgattaccgtgggcgcaagctcttgtatcagtttcaaggaacaagtcatgactaaaggaacagacctccgctgtaaggattatgccgacgtgttcagaagtttcgtcaacaggggtggcttccccctgtctgtacaaggggattccgtacaactctcgtttcctgacgaggatgctgtgcaagcgtgggatctcgccagatggcacttcgagcgcgatgtggtgaaccttgtggtctggtgtgaccctgagttttcgcgggatttagtgaaagacatctgtgggttagcggtatggtatgattctgtctcgacgctgctctgggagcaggctaccagccgcgaaagtgtcacgttgcatgatgtggcgaacatgtcactcgtgccgcgcgtcattgccatggacggcagcaatgctttggctgagcacttgctgtctttgcttcgtgagcagcgcttttccgcggcgcgccaagttaatctgcccgagctggcatgcgagctcgaggcttggtcctcgatcttgcgcagggcagctcttagctggcgtgtgtgggttttcttaaacatcagacgcctgttccggcgtcgtaaactccgttgacatgaccaaggacgacatcatcaacaacatcatcaccaaagaaggagggtacgttgacaacccggccgaccgaggtggtaagaccaagtatggcatcacgcaaaagacgtgggatggatacgccaaaggaaaaccagtaccggctgccgtggccgagctaactgagcagcatgctcaggccttctacaaggactacatgcatcgcttgggactggataacctttccggacctatcctgcagttcatgttcgacttcgccgcccattcggggtacgaggcgttccgtcaagtcaggaggggtcttcccctcttgctcgtccacgctggaatcgaatctgaccccgccaccggctggaggggcggtacgaaggagaaggaaccctttagcgatggtgaagccgccttcttgatggggctacccgctgatacggctaagctcttgttgtggtgcgtcaagcttggcttctggtggcgtggcgtgaaacagtggtatgagacccatccgaagggtaccgccgcgagagaatggaacggcgaaggggtagctcccgaaggcgtttccagacccggttttcatcccatgtatctcagaggttggatcaacaggtccctcgatccactgttctggggtgatggcttatatgccacagtccccatcttgcaggccatcgttcaggcaatggcaaggatgagccgtagggaacaaagtacgtgggtgacgcccctttggggatcgttcctccgtaacttcccataccgtgacgaggtattgaaggatgttccgaccggtgagtgatacagctcggtgagcgtgccatgtggcacgctcgctc

SEQ ID NO: 272 - DNA, 1444 bp, Unknown
  derived from dsRNAs of unknown virus
gggcatactaattacgatgcgcctgatttggctatctacctgatggctatggacagctgctacagtttcctgtcctatctgcggcgtatctatggtgttgctatgacttttagttacaccaatcggtattatcccacggctatcgtcaacgctatggatgtgaacttcgaagacattcatcgcaaccttgccgatttccgcgcttacatcaacagccttgcggtaaaggtaggttccatgtgtgttcccgcttctatggcgtatttcgccagacacatgtggatgtacgagggatattaccttgattctaaccaggacaaggctcagacttacctgtatgttcccgatggattctatcagtatacattggatactgattccgctggtatgctgaagtttaagccactcatgccctttggttatcacattagctctcggaacgtcagtaacacagctgacacgcttcttacctaccagcagcttcatgactatggagatgcgctgttggagcctattctccagagtgaagatatgaatatcatgtctggagacattctgaaggcttttggtaaggagaatctgtacatggtgcagatgattcctgagaactatactgtcctacccacctataatgaggaagtgttgaaccagatcaacaacgcaacgctcgtgggtcagtatgtacctgagtctagtaccgtgggtactaacattgggcagcttaaccagagtacggataagggctacctcattaacgaggtaatgacttatgtcacttctttgggtattgccaaaactgacattgaggctgtgaactggagtgctttcacagccaaacagcttatcaactttgatcatggtgatgttacgccagcagacaccatggtagcttctcggcttacgcatagcatgcctaaacccgtctataagaatgtgaaaactggcgcacgtgataacactggaactactaatactaattccatgtctttcacttccaatgacgggtggaattccatcagctctgaggtagctaactacgctgtagtgtactacttcgacaagactggattgatgatgtcggaaggcatcactactgtcgtcccggctgtggtgtcggttgatactaccggcggtggcagcgatgtttcggccattccagtgaatcaggtgcagagtgacgtgtttagaattaacatgctaagcatgtttaaccgtcatccgcgtgttgcgtatcagtttgtgctcacagttcacactactgagcaggatatgtacgcggcgggagcctttcagtctaagactggtgacatcaactactacacggtggtggatgacactgacctggcccaaatggctcaaacagctctactgtccatgctaaatgtgactcagtttggcagacagcagtaagctgtttgataggggtgctatgcacccctatccc

SEQ ID NO: 273 - DNA, 1351 bp, Unknown
  derived from dsRNAs of unknown virus
gaatatttcttacaatataaaatttagtgttaaaaatcatgaacactcctcaaaagaagcaacgcgtagaaaccaatagtgacagcccgagttcagtcgcgacattgattgacccaattgtatcagatgacattgaagacctggatgatatacgtcctggtttagaaaagttatcaatatacgttgagcaaacacttgatcgaatgtcgatcgcgggaaaacattgtgtatcatcagatataatggagctgaaagatacgatcagcatgtttgaaggtaagttatatgaacacgtacatttactgctcacggatgatcaccattatgaaatgttgaaatcagtagaaattagtaaaataagtgtgtgtctgatgaacctgcataacataatctgtttatacatagatagggtacatattggtatgcgcggtttggcgtccttaagcgcaacaggggggaaacagataacagaaatgagtatagcgctaattggaacaccgacgaaagcgaatggcttgaaaaggaaagcatcagatatgtccgtttcaccttgttcaagtcctacattagaacgatgtatgactatgatagctgaatcaggaaagatgttaactatgtgcacattaaactacgcgaagtcaaaaggtttgtatataaccttaaagaacctacgcgatagggttaaagtaatgcaacaacattgcgctgtatcaagcgcatttatagccgaagtcgctactttaactaggtgttccaagtaaagcgcggatgacatagggtgtatagaaccccgtttcgaatgacctgggatgtcgttaaaagcatccatgtttgtttctatcaaatcatgaatcactatatatataataatacaaccgtaataatgaaattacaataatatacataagatatcaaagttctataagtcaaattctctttactatgtcgcgcggtattccataaaaaggttgaggctctgcagtcaccatatagcctacgggtggtggcccagtgatcgaggtcgctggtaaaatttgacattttgtgcagccggtacccaaggtgtcgcactattaattcattcgtcattatacaatggcgtcttacgacttacatattagtataatcgatacagtatatttataataggtttcattttagttgtattacaaatatatatgaagtgataaatcatagatgggataaacatacatgacctaggacgtctttaaaagcacgttgtttccttcttactaagtagacgcatgaacaaataatcatttagaatgagtaccgtgtgagacactatcctggcccgggtttgattttgtgttagtaagaatgaaacatc

SEQ ID NO: 274 - DNA, 1322 bp, Unknown
  derived from dsRNAs of unknown virus
gaagttattgtggacatcaaagtagatggacaatcatacgattctgtgtggagataacggtctttatgagcgactccgtaaagaagttgggaggcgtgtgaagggatcaatgggtgtgcttaaggaggtgaggcatcaccttacgcccgcaagtagcgggggggtgacctttcacggctgcgccgaacaagggggccaactagaggtgatctcaagttcgggtagacctacggccttcacatcggcgccaaccacacttgtggattcgagtgtagacatcaacgctaatgcagccaacagggtgttcgacggtgatattgtcgtcatgaagcgtgttagcttgctggacactagggctgacgactcgaagagtggactgatccacggtgcggtgacccaacgtatcggcgcgaagtacaaccacaccatcggaggggttctgaacacgatcgtgacgccggtaggcggcgcgatgcaggtgtccgacatgcgtcgttttagtgtagctggctcgtttggaatgacgggcgcgggatgtagaaaggcatccgtcgtatcgccttactttggattgaccggcagtagacatcgagatggcggagggcattcgatcgataacgacgacctacccatcggagcatcactggtgactgcgggcacccccatcctaacggttgaatctccctacgttaccggcgtggagtatcacgctccgagttgtgggatcggaggcaccgtaacaatgacggtgcgttacgcttgctcggccggagcgaatccctcgtttactctaactggcattggccaagatggacgacgtgtcgacctggctgtagctagcggggacgtcacggacacgaatgaggtgcatggcatcaccatatctgcgagtgcgtcggaccacaacctgcgccttggagccgcatacttgacggcgagcagagacatcacgatgcactccagcaatggtgtgctcgcgaacggcaattctgacagatctgacctgcagtgtctaatttcagcggagggcctcggaagcaatgacgtagttacatttgaaggagcggcgctatatgtgggtagctctacagaaccaagcctcgtttccgaagccacggacgcagaagtggaccttgacgctattgtcaaggagtacaacgccgccgctgccgacgccgccatgggggatggcgcggagtcgtcgaggagtggctatggaggctattaaaaccatcactaccggaatataacatgaatatctatctattagatggcatacgcgtcgcctggtaagcgttgctcacgcgcgcaataagaaaagt

SEQ ID NO: 275 - DNA, 1286 bp, Unknown
  derived from dsRNAs of unknown virus
gtgagtttacgcgcgtgaggtacagttcacagcgagcgcaggcgtcgttggcccgcaacatagccaactccaattccagcgacaagcaggcgcagccgaggcacccaaatccatcgcaagcacaggcagtgaacgaggtgctgaacatgcgcatactgcgtggggctgacagagaggcggtggagaactacaggtacatagtgctgcaacgctggacgagtgtgcgcgtgaacaaaggccacagggaagtgccagtctgggtgttgcgtcatccagtgagcaagaatgggtttggctgcttgcgcttcggcgaagaggaggagctagaggcgatgatgctgccgaaccagccggtgccgtacaaggccagcacggcagccatgctcaagaagtacaaattcccagcagcccgactggcgcgacaggacttcaacaagcgggcccttaagatgggcgtgcagctgggccagcggtatgaggacgacctcgtgtcgggagtagcagcgccgtgcatgcctgacaagctgcaagtgcaggcagcagtgcgcacggcaggtgattggtgcgattggttagataaggtggcaccaaacgaggcagtgtaccgcaagggcaaggcgaagaccagtgtgtggcaatacggctggcagaaggactcgatggaccgagccaagggaggtgaggcgaagttgaaggccatggtgcagctcatggaggagcaccttgagcaggcaggtgagggaaataacctgcgaaggcaccagaaagtgcagaacgaccactggagagcgttggaccctgagtcgaatgcacaacgggtgtcaaacgcggtactgggcagcatgaacagtgtgcaccgcgtttgggagaaggtaccagacgaacgagttggtgaattcgttctgaagatgggaggaaagcaggccgcaggagcatgggcggaactgcaagcacaggtgccgcatagggtggcatgctggatggtcaaagggaaagtgtcgcttggagccgaatggcccacgcacgctagcaccgcattacgcgggatcgctagccttgtgtgggccagggcattaactgagctaacacccctgcatggaccgaatggaaatgcacgacccacttggtggatccagtgggcaatacggctgcgagctgctgtcaatgaggcagtggcagagagtggcatagcgcagagaatgcgcatatagttctcacagacttgctgtgaggtgagctagcacatctagcaggcgcttagcgcaaaccggaatagccggtgaata

SEQ ID NO: 276 - DNA, 528 bp, Unknown
  derived from dsRNAs of unknown virus
cagcctttgcagcagatgaggaagctgcggcggcaattgtgacagcatacaatcatctgaaatactcgatcaagacgacgaagataaatgtgaacaggttatacaccgagttcttgagaatgaccatcgggcgtgacggagttaaagggtatttgaacaggttgatcacaagtatcctgacacgcgcaccaggctctgaggatccatttgtgccacaagatagggcgaggatggcagtggagcaggcgtcgcaaatggtggctcgaggggtgaaatgggaaaaagcagacaaatttgttcgtgttgcaatcattggtgcaacgaagtggaagagcgagatggttgttgactggttgaccagttcgacaataaggggaggaggcggttggcgggtaagagagaaatcagactcaacatggaagaatgaaaggtcagaaaatgaggtgaagatagcactacgtgaaggtaatgtgctatcaacattcttgacagaaaaggccaagatatggggggttgagaactctcaag

SEQ ID NO: 277 - DNA, 570 bp, Unknown
  derived from dsRNAs of unknown virus
gattcgttcgaggaagctccttccaaaattccctacctatcgcttgatagatggcgctcgtcgatgacgtggagcgctgggctacgctggtattactagtggttatagctctaatcgtactctgtatggttgtccgatcgcggcaaatcgtcgctgatttcctggacagctgtgctcgcgcagacgtcgattttaacactgaaacacgtacacgcatgtcacgtcgcacttcgatgacaggtgatgaaatcaccgatccggaggatgtgaatgccgaggtttcttcatcaggaggcactgttggggggtcggatcctgtggatccagcccataccccggcgcccccggctcttgagagacagccatcaattcgaattggtggcgtgatcattactcccgctgcaccccgcgtaaccgcacggggcatcactcagcttgggtaggttgagccacaacgtgtgagaggttgcatgagtggcaggaaggagtggactgacatttgattgtggtttcccaatttcccctgggggctgctggtgtgatcggatatagaagaacgcttggtgaacc

SEQ ID NO: 278 - DNA, 630 bp, Unknown
  derived from dsRNAs of unknown virus
gagaaagaaaatctttcttaacttaacaactcgtgaagagtttctaaattttatcttatgaaagtgaatttcagcaacgttcaggctcctatacacaggaatcttgagaatttaaaattaatatgtgaatcacacagacgtgtggcgatcataggcccatctggaatgggaaaatcatttattggacgggcggtggacgccttttctaccgactatgtcggaagcgaaatagatgataaatggtttgtcaatactaataagctcccggagacgggggtttgcgaaggaactggcgataatctaaagtcatgggtcaaagtttttgatccagatttgattgttgtagtagccatcgagagtggacaaaaattcaaagaagtaatggcggctaaggctcgcgattatgacggcgaaaaccaacatttcattgatcactggctcaagaagagcaagtggtcggcaagacaagcaaacaactacatcgtcgataagacgaggatgcatgttgatattgctgaatggttaaggattccatcaattgttttcgtaaactctcctcaagagtctatcagagcaggttgggatcataagaactgattactagcggaaaaagattttctttctccgcgc

SEQ ID NO: 279 - DNA, 757 bp, Unknown
  derived from dsRNAs of unknown virus
gcctacggcgcctaaatttcaatataccccatatgaatctggcatgaataatgccgctgcatttgttgcattttacgctacggcggctggcttaatatctgaagccacacttacaaaccgtaacttaattaacactgcctttgcagcagataggttccaaagtgacttctttcagttagtcccattagctgttgaagcacatagacaacctgaagcgtatttagccgctcctccagagattaattttgatcctggaatgctagatgtgtggatgaataatcctttagaggctgcagatgctgttcctgcacaacatcgacatgctgtcgctaacctccaagccaccgtttacaaagtatcttatggtactgagttttcaagattggcgaatgtattaacatcagattatacaacggatgttacacagtatcagcctggtattctatgcccgcttaatttgagtctgggtgcaaatggcaataattaccggtttataactggttctggaaacgactttccatctggcattacgaatactgcgtatactccaatgggtgttatggctagacaagctcataacgtgtacgacactactaatacctatagaattacaccaccaggaactggtcgtgttattactaatggtgataacgtagcatctgatacgtatcaggtgatggactctctatttaactaataactgatagttagttaggtagttataagatcgaaagatcgggttggcgggagctaaccc

SEQ ID NO: 280 - DNA, 851 bp, Unknown
  derived from dsRNAs of unknown virus
acggttccatgacaccagctgaagaacaggagagttccctcggttacaacagcttgctcaagtacgtaccggacatgatatggaataatcgtatgttgcctcttttagcgtacaacaacaagctcgttcgtctgcgttatagcgacggtaacgctgtggccctaacgtttggtgattatgagtacccggtccagaaacccacttacgcttctgaatggatacaaggcggtatgacgatcgaaaacgcgactgtggctgttagcgcatcgcgctgggtaccacgtgttagctttggtttcaggcgttgctggccagtttggggtgtaaatgcccgtgaactgaacagagtcatgcttggtgtgatccccggttacattgagtcttggcaattcggcgacgtcgtcgtacccccaaccatcttgaccaacgaccacatgatgaacggtctatcagacatgtttccgggtgctgtcggtggtgatgcggaaaactcgaacgcctctacaacgaatggatctgttgcagagggtacgaaagtggacgctggtgtgactatgttgatgaactctgcggtcggaaaccacgacatgcagttagtcaacgagtaaccagtgtgttcgaaatgatcctcattgtgttagaacgagaaggtaaggttgtttctcctttctggttacacgagttcttaagtgcgagttacgctgctggttacgccagcaagtttgtgagcagcctgttgctttcggccaggcacatcgtaccactagatagtgtaaagagaatagtcgaggaggctacggagatgataccaacagtgtggcagacccctctgaaagtatcggacctgcgat

SEQ ID NO: 281 - DNA, 928 bp, Unknown
  derived from dsRNAs of unknown virus
gaatatttttgcttaacttatagtgttatgctcacgttacatcgacagtgcgtaagcatgcctaaaagatcgactccagctatgcccactggaagtctatctatcgaggagacgaggagtgatataacatcacttgttctcagattcgaaaagaatggcgatgtcgtttctcaattagaagtggaggtgaaagaaaatgggaaggtcgagttacttcttaagggagtcaacttcgactggtccgaaccgctgattgatacaaatgtttcattagcctatacggaagtaactaaatcgaacgacgatgatttagatactgcacacgaaggtgaggataaaatgttagacacaatcctcacgacgtgcgaaggcctactggctgacgaggtgatgaccaagattgagggcacgccgagtcgcgactcattccaagcggcgctcgaagcccttccaaggatcaacacacccaagccaccatctacggtgacatcatcacccgcaccatccgagtacggagacgatagctttagccaatatataaaagacaccatcgccggtcggaaatacagcgtgaagcttagaaaagacggcggattaacatgtgacatgacaaaggcgttaggggaaacgagcaacaagcacgtcaaaaagaacgtgttcgttgtgaaagcgaaaaccccagcgaacaacgtcatgatgttaatgctctcaaaagcgaagccaaaagccgctcaccatatcgggagactcccgaagggtattgagttggcgattgggaacggaaaggcgtcatacggcttcaatgttaatgcattggccgttggatacaccaatgaagagatggacatgctgagaatagtcagagaagctgtgattttatactacatggcgtgattacgccgaatacaggttaagcgaaacgaacatc

SEQ ID NO: 282 - DNA, 881 bp, Unknown
  derived from dsRNAs of unknown virus
ggggtttcaaacgccgcactgtaaaccggaggcctttaaaatgacggaacttgaagttattatttggacatcagttttggtgttcagtagctttctcttcttgtatgtagtagatactatatatggagggttccgaaagtgaggaagcgacgctgttacgcttgctcgatccccgagcaacctggttgcgagctacattatttctgttcaccaatcagcggtgagcctgtaccactctgtggagtgtgtgaggataaaataatgcgagcatggaggatcaaaatataataataggagagtggtaatttggtaatgtacgatgacagagatgagcgagatgtggatgctattcacattgactatcgcaagcctgcagatccaattcccgtaccacaggttcctatgcggcacaccgatccaccgccgaagaagcgcaatcgacgtactaaggcaaaggacctgatcaaatccgcttttgaaccaggtggtttatatatacacaagcgacaaccagatcccaatgccaaggatctaacccctgcacttaagacagctggaagtcatatagtgaaaggtgtccctgtaggtggtgctagtgcggtagctggtttagccataaaaggtgtcgttggcggaggtaagtttggtcttaagaccggacttaagtacggccctgcactcgttaagacgggaatccgagttggtaaacgagtgcatcaggtcactgaacgcactaataactttgaacaagtatattttggtgaccctgccggtaatgcggctaaaatacatagctatagtagtggtttctatgacgccatgaaatagcaatcgtctaattggagacgatggttgatgcccaacatcaaccacctatcctt

SEQ ID NO: 283 - DNA, 872 bp, Unknown
  derived from dsRNAs of unknown virus
ggagaaagaagagagtagaaatttccctcggttagctgtgaccgtaaacggaaattgaaagatgatgccctatcatccaaagatttacgaggaggacttcctggccaaaatcaacagtctattcatctacgttgactggaatcgctcgccgctaatgcaacttcagtttgtcaatgctctggataaagtgaactcatcaggtttcaaaagaaagcaggttcatcagtatcttaagatacgcggggcgtatggcagtggtgttgttttcactggagactctgccattgatgtcacggataagcaaaagaaacgcccgaacattgtgtggcggaacttttgcaggaatccacaagtagtagagcttataggcagggagctgacagccacagagcggaaaattaaggatcttgatgacatccctaaggacatcatggactattttcatgacagatacccccaaggcttctacatatcgtattatcagaagtctaaaaccaataaggatgaaatgaacgccgaagtcaccaaacgattcgcagccctgagacctgatctgcagcagttaacgcttgaggttgtctgtgacggtggtggtggggacaagtggaagttgcgtattggtaattacacaaccacacactccagcaagaaaatggcaaggaggctagttattctgagttatgtcagtaacagtgcccaagaacatactgtgtacgatgaatagcagcatccatcccaatggcctcaagtaaaatgctctcgagaaagttaggactacccgggcctagcaatgtaagccttcagtacattgaataactcaagatgtggtaccatgttgagttttatcaaacactgaaggttgacacccccga

SEQ ID NO: 284 - DNA, 961 bp, Unknown
  derived from dsRNAs of unknown virus
tacagtttcgatggcatatgcgtatttatatgcagtgaatttacatatgcgacatctttactggactgaaggtaaacaaaacctgactgaaaggttaggactcgtgtttgatgattccatccgcacacagcatatgatgctagctgatgagttatctactcactatttaccaccgaccatcatcaaatatattcatagtttgtttgatgtctatacaactggagtcagtggtgacgctgtactattccagttaaccccatggacgtcaggatataataacacgtcagcttttgaagctggatatttaacacatatcgctgcattacgtggtattagcaatttagattcactgagaggggcgtttaattcacccttctatcgagatgccagaatcaaattggaaatgttgagttttagcgaaggttttaagaatcctgataactttcttgctactaaaccaacacctgctacttttaatgaagatatgttcaatatatggactaatcttccattggaagcttttgctgtagcagtggagcgaattgccgttgctgaccgcactacgtccattccgttatgctatatcggagacggtataagtaaaacatcacttaggcacctctctaagtatattaccacagatctgagatatcaaccgggagtactgattcctgcaaaggatccagtcgccggaggtgataataatctgaaatacatagatgcagctggccaagagcttgaagtagacatacgtactgcagctggatttcagggtttaatcttaggaatacaagctagacttgctgagaatgtttacactaggactacttccacaatgggagttgtgaaaccatctggtacatcacacgtgtatacatcaatgcaaagtattggttatgatgtttatgacttaatgacggaactattcttatagaatagtgggagaagcttcgcttctccc

SEQ ID NO: 285 - DNA, 1010 bp, Unknown
  derived from dsRNAs of unknown virus
cgaaacaagtttcgacatattatgtattttgggacttgtttcgggattcgatcctatggtaacaccaaaagtactaattataggaccctcaggatcaggtaaaactagcgccttgaatgcagtggcacgcatgcatggtgttagctctacacttgatctcgacttattgggaaatcatccctctccagatgattactcaaaatggtttctcgatgtgcctagcataagaaaacttgtcgagagccacaacccgcttcttgccgctggtatttcaaccaacgtcaggagctggattggtttggaatggacacatgtaatcatgctccttcccgatgctgaactgttagaaaagcaaggaccagcaagggataagaagcaaggtcgcagggaagttccggctgaacagtatgcggagtgggctagattggctgagctttattttaaagatttgccaactaatccaaattctaaagtcatcgaagttcggtattcaaatataaataagatgataacccgtgtgatgggtatatatcacgagctattcggagcacgtccattatgaacgacaccaatgacgggattaatcattgtgaatgttgttatgtcggacgtttgtcacccgatgaaagagcgcttcttgaagcggatctcgattggttggcatccaacgatgagcaagacaagcactggatggaagtgttcatcagtgtaatggagttgttaaggcttaaattaatcattcaaggagaagatgatgagcatgatgacaaatccgttggcgatacaccctgcgaacaaaccgacgtgtgtaccgcttgtcacaacagccaagtgtgtcatttgtatagtcaattcgcctttatagatgatggctattacagagtcgcactccccttctgtgaggagtgtgtgccactcgacggcgaacctgtttgtcacgatagtccttatcgttaggttcttcaagatgttcagatgatgtctggatcggtcgcttcgaattacgaccg

SEQ ID NO: 286 - DNA, 1091 bp, Unknown
  derived from dsRNAs of unknown virus
gggaggagacgcttttgcgtctcctcactcagcatgccatatttcaggcgttatttgagtgactatcctcatcaacgaaatccgcaactaaacgatacgtcaaggcggagaccgcctgatgactaatcgcgttagctccgtcaaccgacacgctaaatggcaccgctctaagcagcttaccatcaacatggatgaggcacgatagagtgaatgactcccgatgaagtactaagtgcaagtggcgtcctctaagacggttcacctgctccattcgtttctcggcagcattcatatcgattttcgaacgatgattggaactccgaatgattcttcatgcgcagcgagaaccgtaatcactgttacgccgttccgcagcacatgcgccatcaatcttccttcgtactcacgttctatgatgcgatcgactctgcgcctcagctgtgcgaattgttgaaccaataggttctgttgaacgcgtacagcaaagggagccttgtcgaatcttagttctcgcagatgatcctcagcttcgttttgagcgcacaacgcgtctctcgaaagctgttctagcatttgcaagtccagtgcgttcacaacgcacctcctgaacggagcattgcgcccgccttaaccgacccagctctctgtagaacgtatatacccgctccattgaaggagtccgcaggcctacaacgctcaacagcctgtttcggcaactcgcccggctcagcgaatactacacacgcttttggcgagagtagcaccatttgactggcaccgtccaccattccggagaacaaacccgcggcaacggagtcggtgattacttgaaacggagacgggacttctggtcccacgactattactaaatatggtttcatgagtttggtgtttattcaggtcgttagtcctcaggcgcttttggaggtacctattccggctctatatgtccgacttggtaagcgtacttaccccgggatcgctttcgcttcgcccttaagtatgtgtgaaactaggctctccgccgtcgctccaccacccccttacgggggtaagattgcttcctgctaacgattgctgttttattttcc

SEQ ID NO: 287 - DNA, 1115 bp, Unknown
  derived from dsRNAs of unknown virus
gaaaacaatgacaattaaaatatacaatccgtggaaatgtgatagaccacctgataaaacgacaaaggtgtgctataacgttaaaactcaagaatttagagtgcaacctttaaattctaatgaaccagagagtgacacagtcgatactgaggatagtgatcatgatgatgaaaggtcagtgagcgaaccggcaccatttatgttgccaacactgaaaggaatagttcaggctattgctgctggagtagccatatatcgattcggaggggcttggtctggtgccatgtcaggatggaaagatgttgggctgtttaaaccttttctcaaaacactcaaagcatacaataagactggtagtctattgtcgtctgaggaatggtgtcctgcagatcagtggttagaaaacgcctatcaatatactcttccaaatagtataggcgttccacaacttatgcaagatatcgtatcaatagcagctccaatgaacggcattgctcttgatggtatcgcagcctttgtagctgcctctgataaattcgtcgaatggggagaagaagcgagaagtcttgctgaatctattgccgaattcgaggtcgaccttgaagatatcatgctgcctaagctacaagagggagggttatacactgaagagtctcgaaatacaggaggaataggcgggtctattaattgggaggccatgttagccccagtctggaattccattgccggagcctataataccttgattgagagtatagctgctgatactgaagagatccttggtaccgtagcaactttcgtcaaagtgggaggagatgtactttcagtagcgggagaagcaggtgaagtcgtggaagagatcctgactaccgaaactgatgactttgaattccaggacacagggaacgatgaggcagatgctgcgctcgatgaagttgaagaacacctctccaacagacctccagctcccggtgaatggattattgacgcggccgaaaaggttaaagatgtaatccaaggcttctttgagttctaatactgtatcgctgggttatacttgaagttcatcgttttcatcaggaacggcaaccttaaatgtcgaaggccacgtcctt

SEQ ID NO: 288 - DNA, 1108 bp, Unknown
  derived from dsRNAs of unknown virus
gggatttttctcgactctggcatttcgtctaccgtttgtgtgtctagtttataccagcaggtgtattagtagtcatcatgagtggaaacagccgaatcgcattgcctagtcaacgtgaatctgaaggagtacgtgtgcttagaacattcagaaataagcaactgaggagcctgatgcccggcatcactggggtcaaatgtgtgcgacaacatccaactgagttgcaaccaaaggctcaagctttcacaattgaaaatgtgaaagatctggcatgtcatgttcttaaatttggatccccaacattgaagcaaaatttcatggcattaacatatgaatatgatatgttcggaggtgtgcatctaggattgttctgcttgtcagtgcgacgtggagcatctcaaactgcatacttattcaccccagatctggataatttcgcgggttacatccaagaccaggtgaatttgactgatgatatgcggatcacaatcgcgcaaggggccgtcgcaaccatcaactactacccaacaacaccgagcaagcttttcagggggattccaattctgttctttgcccaatcagactcagatgctgatctattcactatttacttgatgatgaggtacgcttactaccagtacccaaaggaagggatagctcttgagggaagtgatgatttttaagttgtaaaattatgaaatagtaaggtcaaaattaaattcggattaatgtaaataacacatttaacagttaaatttaatattattatgcattttcattaaattaaattaaatcagatttaagaatagcaattgagttaaattaaattcaaaattccattctaaaattaaaggtaaattcaatattagcatcaagtaaactccagatgcttattgtgtgactaaatttcaatgtcacttagtaaagtttgtttcatatattcatgtcatattgttatggttataaaattggacacattaattggcaagacgataccagtggtaaacctcacttttcacaccaagtgagggtatgtagacgcgacgtcacgccaccgtcggacgtcgtcagtctgcagcgccattgggtcaacagttagaaacagacc

SEQ ID NO: 289 - DNA, 1150 bp, Unknown
  derived from dsRNAs of unknown virus
gggataatttcccccacccggttgttcattggaacccccgggaggcactcaaatggagatgaaaaattatgcaaatacaatcagcgcaaaccgcgcagttcactggcacagctgctagtgaacaaacactcgtattaaagagtcgtgcattatattctggaatcagaatttcatgcactggtagtggcacaggccaccacacaaagatgctagatgcacttaacagtctagttctcgatgtacctgaatacgggtctaggtcacgtcgtgtagacgtgaactccgacactaagtggatgttacctataatgtcccaactcagtgcgctttcacaagcagacgctaacgcggctacttctttagctggctcctctggagacaacttaactgcctcgttcgcatacattgatttgcctgtgaacaaactaaatcttgaagaagatgtaagattgacgattaactgtacacctggcacagctgctactgcagtacagactttccacatatctttcttggactacgcgttcagagatatttacttcaggcctttcttccacgctgctgcagcaagttctgtacagcaatggttcccatctgatggggtactacgtggtgtagtagctgtagctactgacgggtccgaagctgctggaagctgggctgaagcacgttctagctcaacagttactcaagtctcactaaatggtgagcaatctacaactttcagtttcccacaattgttgggtgctggtcttgatgaagccatttctggcggtacacctggtgagtactacgcaatagacagctactctatgttgaaaacgttcccaattcagaacgttgctcaatacgtagatgttactcgtggtgcttctaaaggtctattgattatgggagtgatgtctgatgcctaaagtgattatggactacgtaaaagcaatgcctttagttgcaataggtatatccatgttagctggtgaactagttgaacctgcaaaaaggatcagagatatatttgatggaataagaggtgcttaaatgaacttcgaaaccaagaacatattaatggttggagctgctttcttagcaatttcctacctgttcgacttccgtaacgtaccagtacttggtgcactggacatagtggata

SEQ ID NO: 290 - DNA, 1164 bp, Unknown
  derived from dsRNAs of unknown virus
gataaacgacgccggtatggcgtcgagactcaggttaaagggccaaccgtaatcgctaccccaggtcaaggcgatgtttctcgatcctcgactcgtttgtttcgaacagccgatcgctgcattaaaattcaattttatgttgtacaacaatgaaaaagctccggttaactcggagtcagtgaaagaaggtggtgttgttttaatcgtgtctcatgatttagatcaacacacaatgttgcctctcactctcaaaagagattttgggatcaagagtatgcggcattggttcattcgaaatgacctgcagcccaagcaagacgcttatgctggtgtccagttcagcgaattcatgggcaggaaggtcaaggggttcttcgctcccgtatcatcagttctagcttccggcgttttggaagttgagactctccgtgacttgtgcagtttaaccattgtgcaattagtccccgagttccatggatataaagcgatgtgcaaggttatgggaaagatttacaatctcccagatcttgaagctaaaggctttatgcccgatgaggcattggcccaggagctaagtgaacagtttcttttaaacgtcattgggatatgtttcggtttgccgaactctccctttgctgacgacggtcgatcaggtacagtgcaggaaaagattcgtgcatctaaagccttgttacatgctgatagagtctggaaattctttaacgagaatcagatttcctatgctctatgtaaagtcggggacaatttcattggtttaggtcgcggtaccaaaaacactacagcgtgaatcgaattgaaattgctcagtcgctgctaggcatcggctttgcgagttgtattatcggtttggtcacattgctaacaatgaccaacgaagtggtctcagcatcacgcgttttgtggaaacgtttactgtttctagtcataacggtatttgttgtctctcttttgtgtttcgttagctccatatgccttgccatgtgcgaggcgcatgagaatcctgtacgatgagaccgcatcatttcactcctgtgagtttcagattacccaagggtggtctgagaccgaaatttcgtcttctttatgaggacgagggagagttctgggttccattgaatctagaagctttctccatctgcgtcc

SEQ ID NO: 291 - DNA, 1218 bp, Unknown
  derived from dsRNAs of unknown virus
gggaaaagatcccgtcaggtatcatacggggtcttgcaaaggagccgcgccatggctactgttgaaatggatctgacgtgtatgtttggtgagagtaatcgtgtagtggttcgcgccgcgagtttggctcgggatcagaacgctcggttttctccgtattgctgcgctcacgcgtcgcactcggagttcgccaacgtgtggaccctgctgaccgaggatgcggaaggtcccgtgctggaggcgtatatcacgtgccccccttgcgcgaatgacctgctggtcaagattaggaccctgctcggcttgttgtgcttgaaagagctcactgagctgaaagggcccgctctcgaccagttcatctacgacctcgatcccgtcatcaagggtcttgatcgacagaagtcgtgacgggcaacgaaaccctcggtagaggggtccaagtatcggggttgtggatctcagcatccctatccggcctccgggattacggaaatggagatgcgaaacaacccctgacactcccagcaatgggagcacgggcggtagcgatactcaacgtcctttgtcccccgaggttcgaatcatgaatgccaagttgaaagtcgtccgggctagaataatctacggtgccccgacagttggtaaaacctatgcggcgatgcgactccggttggagggtgtcaacgtgttggataccgacgagatcacatgggtcgtgatgccccgttggtttcgtgaagagttgtggcgaaaggagggtgggacccagattggcgagaggaaggaccaggtcgttggtgaggtcgctaacgcggccctgctcaaggacccgaattctgtcctctttacaaacttggccagccctgcgttccgtggtgctctggctcccagtttgctgagcgacggtcggattccgctgggcatagtccgaaaggaccctcagcagattcacgacatctcgcgcgagcgcggaggggtaggtataccgctctcgctcgcaaagaggtggttcggcaagcggaccgagagttggatttctcaagcggtagcgcgagtgatctggctcccgactggcgatcgccgttactacatggacgatgtagtggagttcgcctggccgttcatgaagcgattcgatcagcacttcgtggttaacaccatgagggctatcggatagcgggcgagaatctcggtgcacactggtaagggtgcgccccc

SEQ ID NO: 292 - DNA, 1178 bp, Unknown
  derived from dsRNAs of unknown virus
ataaacttcagaggtgattgacttctccgacaacgcgatgaattggtcaaaatcaataaactttcaaccatttatgatggacacccggccgcccttggatatgattccagtcactaatcagttggttcggctaggtcagcaggcaaatcagagatgggaaatgaatgatcggctattctttgcaatcaaaaagatgaatccggtgttcgttactggcaaccatattgctacaaaatatgactataccattttgcaaattcagacccaattaatcgctacgctgccagaaacacttctgttcttagcattctcctactatataagagaatatcaagataaggttggtttaatgcgatattaccctgtagcggtaaagaacatgattccaatcctgacatacttgaaaaatcacgtccacaacaactatgatacaaccctgaatcaagcgtatcgtatgaatgttgttaactccatgactgccaccgaagcgtttgacttactttcgggaatgttggctactaccaggaatgagttgattcagagaacgagattctgtcccgaactcttgaatgtactcaacaagatgtcgttcatgatgatcttcggacccggaagaccagccttattcacgtggaagcgtcagggttgagatagttgatgtgatgtgggtatgcaaggcatgcttgaaccattacttttaagtcaaatatatggacataaaatcatagactcttgttgctgatgtttagaataaggtgtaacattagggatatgaatgactaaataataatagtagtagtttgccaatggaaaatgggatcttgtgagtaaggagtggttataatcgaaataaatatatcacaatactttgatttctcttttgaggctttgatgttgatagaggtacgcatatatattttagtgattacttaaatgcatcattattatcaatcgttcttgctttttgtgccattactattgcttgctcgctatcatatacttgaatgtaaatcggttgttatcgtccgatgtgttcgctcagatgaaagactgtaccgccaatcagtagattttgaccgttgtcaaattgtccgagctcaacacccacgaccgaagtctgctgaatctcagtgacgaggagtagcgacccttagagagtgaaagcagtgatcaacgat

SEQ ID NO: 293 - DNA, 1261 bp, Unknown
  derived from dsRNAs of unknown virus
ggcgcatactcgagtggaacgttgttgcacctctactcacgcccaagtgttacaagggcatcgccgcgtacctctggacacgacagggcactaacagctcaggtcggccggataccagtatcatcgcttcattcaccgcagtcgctctgatctggctaaacgtgatggatggcatggggtggtcactcgaccagaccgttgccgcactccggcgtggtgaatgggattacattgacctgggcgacgacatggtcgtgctctggcccgtaggcttcaaatttgaaggcctgcccacgtatggcttcgaggcgaccacggtaccaaacacgatcgcattcctgtccaaattttacgaccccaagaatcccgtgggtcacggactggtctcgcgcatgtacaacaacaccatcaacaaagaagtaagaatggaaccaaggaccatcgaagtggccgccctcggctactacgagcggtctgaggtgctaaaagggcacccagcacaccagctgtaccgagacgcgatgatggcacgtcccaggacgaggcttgtggtcgagcttgctgaccgcatcaaagtcgacgcgcttcgagaggcggtaatgctacaagcgctcgagggcaactggccaagctacgcactcaaggcattgtctgaaacgtcgagtgcattggccggacgaattgacgcacgcctgcgcgcagcgggcgactacggcatatggcatgactacgcagacccaaatctgcctgtcagtgcggcgattaatgacctagtagtactagggcaacagagtcacacaaggagagagttatggacaggattcctctaggtacgcagagtttcattaccgtgatacttgttacgaacgcggcgggcgaagacgtggccgcggtaggcaagatggcggacggcagcgtgattgtcgcaacggcgggcaccgaactagccactcgcctgaagacgcacggacggacggcgggggccaaaacacggcaggaagcgggccgagagatgttgttggccgccacgcccaactacgccgtgacactgacgacgggctccgcgagtgacgacaaaccggcgcccgaagagcagccactaattcagcccatcacgcaggacccacccgcgccgccgcatgctgaaccaccgcctgtgctgcccacgaagatgaccgaagagggcgaccaagtggataagaacgaactacccgcagtctgatagactgcacggtgcacccctatggggtgcacccttccc

SEQ ID NO: 294 - DNA, 1255 bp, Unknown
  derived from dsRNAs of unknown virus
gaatattctctgaagcgatatacattatagcggaatggcgttttacgcgaagcacaaagaagattatgtggaaaagggaggatcggacgaaatccctacgttctttgaccctaaggatctagccatgggaagttatggtgtgcacatcgataaatacctaggccgcagcccgtgcgatggcccaccgggttacgtgttccagaaggtgacgtactcagcaggcgcgatcgcggatgagacgaacgtagcaggagtgtataaactatgcccagatcacatgggttacatataccatggtaggagcgcgtctttcacagttcctgcctccgacgtttctacgacgcaagataggattgcgatcactaagcacggatttcttcttaatgacgttgtcacttacaccttcgatgaaggcacgacgccaatttctactacatcgggtcctctcgtaaatggtcagaattatttcgtggcgggaacggtgaacacaaacaacttccaaatctcggagactgaaggtggcaccccgcttgatattgacggttctggtaatgatacgcaagtattcgaatttaacaatgaggtgcggatcaaccaggatggagctgatttgagcggcaacactgacccaaccccaagtggcatctctggcgaagcgaagctggttcctggcgacatgatcctcggagccattctacagctagtcgatacacgctcatccgataatagaactgggtttgttaccgctggcttagtgtctaacgattcggcgagcccagattcatacgggcgtgagattgcgtccgatccaagcaacttcgtccttggtagctctattagcggaggtaaatccatggctgctatggacttaaaagcttgctccgttgcgagtcccaacctgagtatctacaagcctgttactgtggctacggcatctttggatttggctcccgctgaaattggagcgccaatcaacgccattaacgtctcgggaatctcagcgggaagctctacgcaaattcgttttcagctgcacgtgtatgctttggtcggggctcgtcaaaagacagtctcgcactacactcagccggacccgacgttcacaatgtcatgcctgacaaggcagtttacggaacatccagtttcaatgattcattaatcttcatgtgttcgcatgaactcatcacgttatgatggtatacagcttcgtatgcagctttgtcacgctgggttcacataaaggagatgaaacatc

SEQ ID NO: 295 - DNA, 1252 bp, Unknown
  derived from dsRNAs of unknown virus
ggggtcgaagagattgaggaggaacaagaatgaacgaagaaaccgaaccaagctatgtagcacgacgacaggtcgcaattgtgaacacaatcctatccttttggaaccttttggcctatacgccaatgagccataagcatcatggggttcacgtgaatgattaccgcacagcagttgctgagctcatccgccagcgggttcctacgaacctgcgtgcgttgcacgatgagctagttcgctatgcccgtttggcgtacaccatgccagcgggtgctagttggacagcgctcgtgaacacgaacccgcatccacgattccgtactcgtacgatgaatcgggacttgaacagcgctcttacatcgctattggtcaatttcctacctggagaggaagtcctcataggcaccaccgcatggatcgacgattgggaacgcctgttcccgttcgcgctctttgaggcctatggggttttgcgtgaattaggaatagacgatctacactcactggaggttatctcgagtatcttcggcaatcgaagacactcgattccagtggcgggtctactccaatagtccagcacagggattcccgtaggtgcaggcacgtcagccttttggctgttcattgccatacctctaggggcaggcgatgcctgcacttacactcgggattccctcactctaagatcgggagtgcatggaaacatgttgttgtcgtacacgcgagacacatgtgacctgttgctacaggttcgggcgccattggcgctcgccagtccgttcattcgggtaaattgggtagtcgctataccctcgagttagcagccgtaatgacaagcgaccagttatgaccaaggttgaacacacccacaacgtgcattttgtgggaccgctacgaatcgccaaatgatcgagtacaaagtctggtaaaacttaaaggtacattccccactcaccacgggaggggatttgtgtagatatatgtggaaattccatgacggaatcgtcaaaaactgatgaggtcgtggtgcagattgatgttgacggagatggggagcctgatctctcatttaccgttcatcgcaaactgtggattacgttgacagggggcctagtggccctgcttggtgtggtatgccaggcgttcacttaggtgagtcgatatccacggaagaaaccgggagacaccttggcgtgtcggttgacttcatcaatctgggttatggattttagatccatagccccactatcct

SEQ ID NO: 296 - DNA, 1810 bp, Unknown
  derived from dsRNAs of unknown virus
tgtaatttattattcataaccctatgaactccgaacaattttctaaatacgaagtattctattggatatccggctttgtgctgcgacgcatccttgtgaagaccgtgtttccgacttatggcctagcttcttatgagctgagcaaggatgtaagcctactggttgcaaaagtccttctggcaaaagtcatcttcccttcgcgtaccgacaaggagaatggtcgaaatggtgccccaagcggatctattaacccttatttaaatgaacctgaagatggaaatccgcagaattgacactctggatcttaaaccagaagtagacagtcagctttcccgaatgatgtctaatgttgttcaaggtaacgacaacataattgaaggccccctcgctaaagtacctaaaattcaagaattattcttggaatggtttgaagcgatgcagctgaaagaggctttaaatgagacacttttagataccgaacgtgctaatcaagataaatttggacccagatctatcgcattgccttggttagacaggattcctggtgtgaagaaatattttgaagtcgatactactctccttcctgatataactttaccgcaagcaccagaagggcgattacgaccattgacccttaaaactgcttctgagtatattaaaagaacgacaaattcaggattgccttacttacaaaagaaaggtgtagttcttaaagaagctttagctaacttcgaacaactgttgtctcgtcaagatccttgtgtattattcactcggactcaggaaggcaagaaaactagacctgtatggggatttccttttgcagacactttatttgagatgatgttctatcgtccgctactcgaattccagaagaagagtggctatcgtgcagctgtagtaggacctgaagcagttgacaccgctgttagcagactgatgaaatttgcatcagagaacggactaaagttattaagcattgatttctctgcttatgacacgtctattcgcccggaattgagcaagatgtgcttcgaatacatcaaacgactttatcaagcttcacatcataaggacatcgattacatttatgatagatttgtttcgataggactttgtacacctgatggtatttataccggcatgcatggtgttcctagtggtagtacttttacaaatgagattgactcacttgttcagtacattattgccatgaactatcctcatgagaagcttgaaatgtttcagattcaaggagatgatggactctacgctactaaggatccagagaaactaatggattggttcattcaatttggtctgcaacctaataaagagaaatctttgatttctgatgacgtcgctcaatatttacaattgacatatgcacccgagtatgaagtatccggcgaattcaaaggaatttatagtgtatcacgagctttcaaccgcatgtgctacctagaacgtttcacagattttaccagagatgatattgatgggaagtcttattttgcgataagatctatttctatccttgagaactgtaagtatcatccatggttcgaagaatttgtaagatttatcattaagcacgataaatacgacttgcaagttagcgatcagtcaataacaaactatataaagttaagagatcgagaggacggacgcgacgttaattttaacatctatcagtacggcgattatgctcgcggactgaagagcttcgaaagctataaactagtacgacagttaacgtaaatctctcgtaatacataggttctctatggggtcagtgagtaatcacccc

SEQ ID NO: 297 - DNA, 1761 bp, Unknown
  derived from dsRNAs of unknown virus
gtaaaataaataaaactaaataaattccttaaaattcttttaaataactctgccacccgtactatcaggttaatttacaattattcagagagtagagaaacagctaactttacaaacattcaaatacatgactagaactagtgtagttaagatgtatgtgccaatgcttccaggtagaccaggtactgttactagacctgcgattagtcctcagacgctacctcagactcagcttgacccctcaatgggtaacggcaaccgtgcacaaattagaacaaacaacagtaatgcgaacgcaccgagtaatcgccctaatgaattaccttcgggtaacagaattggaggccgatttccaaatcgtcagcagcgcagaaacaacaataattcgagaccagtggttcctatcatgcgcgaaagaggcggtagaaacaataattccaacttgaaggtagtagccggagattttggttttaacattgatggatcgaatagtcccaatgtctacacaggacattctgagacgactttattccgtgactacaacaagaattcagttaaggtagaaaatactggcttaaacgagaacaatcttacaaatgcttttaaagtattaaatattgatttcgcacagtctattcttaccggaggttattcagacgcttacaaagtgattcgaaataagctcgaaagaacgattattagttcgacaaacgcatcaagaggtgcgatggacattatccaagcccaaaatatctctctttatttagactcagttgtcaaggctttcgacattcttatagaattagaggttatgcaagcttgggatcctgattcaaatcagtcctacgacaaaactcttcgtacattagcatcgaaagtttcaattgcagaagtacttgagtaccgtaacaagatccgaatggctcttattccacatgtcctaccactaggatggatgcagtacatcaaatggctccgtgaaactcatcttcaaaacgaagtagctgagtctacaaaactgagatttgtcagcactgtaacagtgtctgcaatggatgacgccctacaaggaaaagaattctccacttggacttggaagtcccgtgttgatgcaatccttacagatctaaataatcaggacccacgaattccggccttaattatggccaaagtcgaagatccggactttagtttccaaaacgtgaaagatcactacactctagttcacaatagtgctagttatgatcctaacttcaacgatttatataacaatcgtacaattctatggggtacaggaactactacaagcagctatcctaagttaactggaacgcagaacggttatgcggcattccaccgtgttgatccatatgcgatgtgcttagcacagatcggtacgcaaatgaacatcactacaggtgttccactagaaggaaagaaccaaccagttaaggtaggtgaagagggaactcttaacactcacttctttattgagggacctattgcaggtaacatcaattatcgagtgcgaggagttgagcattggtacgagtaccatgatgactctgttcacaacattgaccttactgcggcaggagctccaactaaggcatactctacgccaaaaggcattcacgtgttaaattatgtagcttcgtcatcgaacatccagatggcagcaagagagtctttaactagactgactctaagcaacttctaattaacaaataatagacttcggtcgggtagcgttcgcgcccc

SEQ ID NO: 298 - DNA, 1121 bp, Unknown
  derived from dsRNAs of unknown virus
gaatattctctgaagcaatataagttaatacaaaatgcagtattacgcagcgaatgataatgtgcagaaaccacgtcataattatggacaatcggacaaacgtcgaccacaatacggaattgatctaacaaagaagtatgaggctgaagaaaggatgaagagtcatgaaatggagatgaatgaaatgcgtatgattcttgataagcttagtgctggtaaagagtccattccaatgttctttgaccctaaggatctagcgcaaggttcatatggagttcatatcgataaatatcttggacggagtccgtcagacggaccggccggatacatcttccagaaagtgacatactctgctggagctgtcgcaagtaaaactaacgtcgcagggatgtataaggtttctcccgatcacatgggatacatctatcatgatgccgaaacgggtactgaagtgcgaatcaacggtgatggcgctgatctggcaggcagtgcagacccaactccagctggaatatcaggtgaagcgaagctagtgcctggtgatatgattctgggtgcgatcctacaactagtggatacccgctcttctgataatcgcactggattcgtaactgcgggcctagtgtcgaacgactcagccacaccggatacgtacggacctgaactggctaacgaccctagtaactttatcactggaagtgcaatcagtggtggtcgtacacatgccgcgaacggtctgctggcatgctcggtggcgagcccgaacctgaacatttacagtccaacaatcgtagctacagctgctagcgatctgtccccggctgccatcggtgcgccaattaacgcgattaatgtctctggtataagtggatcaacatcgagccaggtgagatttgtacttaatgtgtacgcgctagttggtgcacgccagaagacgatctcgcattacactcaacctgacccctccttcaagatggaatgccttacgcgccaattcgcggagcacccagtttcaatggtgcattaaattatttaaagctaaaagctacatcatgtattaagtttatacagcctcaaatgcggtatgtcaagccgggttcacattaatgagatgaaacatc

SEQ ID NO: 299 - DNA, 2112 bp, Unknown
  derived from dsRNAs of unknown virus
gaatataaatctgactattaacatactgttataatttaaagtacaaaatcaaaatatcaacacgataattcataagatagaatatgactagcattgtcactactacgcgtgattacgctgtaaatgttgcccaagcggcacttaatggctttaaggtgcaagttcgaggcgatctcgaagcaccaaacggcgatgaaaacgtgcgcatgttcacggctaagggtggctcagctattacccttggtagcactgtcacgtcggcggctatggtttatgatccagaggcatcccttcgtaagggccagcttgatgtcatgatctatggaaggaacgcatcagatgtagtcgtagaaacgaagcgagtaacgctgggacgtaatacgaacgaattcattgcagcgggcattttgagctctggcatgaagatcttcaactcttcaggtattgatgttattggtggaacccaatccgctgccgtcctaacctcagttccccgtgatataagcaagattactaccacagacttggcgaacttcagttcaaatcatgagcgtgatttggcaagtggtgtcgtttcgcgtgaagattccactatgtctctgtgtatgactgagcatttcgggaggaagatggccctctgtcgtgaaaacacagttggcaatattgtcagacgcacatgggatgatgggcttggaacgaggaggacgaccgaaggtgaaacccttaccttccccttggatcgaaccatttctcttagtgccacaccaaactcagatacgacgatcttggctaataacgaaactcaattccgcttgattgatacggacaggctcacctctgcgaacaacccgctaacattggctacatattcggctgaggtggaattctatggtcactttggagatcccaacggttccggcgaagctgtcatttttaaaatgaaggctatgggccttgatgccgccggtaacatcgtagcaactaaccaagtcgttgacgttgccaagctcgtcgataacagcacttatgatgttaggatgagagcaacggtgacgagctcaactaccccaatcgcacgagtcatcctcggttatgtttcaactagtgtgaacgttaccgacgcgttcttggctgcggacagcgtggggaaggtgaccgccacagaggaaacctcggatatcccagctcgtccaatccacgtctgcgtgctagaaggcttaaacgcaagtgcaaccattaatatttccactatggctgtaatctgtggtgtacccgactcaagcaatgtctttatctcatcgtctatcgaatcgggtgccgtattcgatcaaaacgctgtggagattttcctacgctctctagtgagggttatgcctcgagcctttacggttgaggggcatggcgccgtaaccaaagcgttgaccggcctatatggatctgaagccgtggatgtggcgttccatgcgatgtcgttcgatggcgtggccaaattcgtgaagaaagcagcaaacctagctaaggttggagccactgacgcacaaaagcttctgatggaacttgaacctatgatggcttctatgggcgccgcaacttctacgttgcctggccccgtgggcgcagtaggtagagctgccgtaatggggtcccaaattgctaagcgtatgcattgaaagatggctcgtttcccaagcgttgtgaagggaccagaagggctaattcctggaaggttacatgcattgatactgtctactactccattaagcagagagtacgttcgaatcgaaaacgtcatgattgataaaaatataagagattatggcgtaccgatcttgaacgcaattaaagatcgtggttatacacatatttctttgttcaatgataacatggtattcggtagatcttgggaaatgagcgcggctaagctattacttgatatacccggtgtcttttcaggtacagtcgaagattataaaagtccaaacgtatttaaattcggaatagtgcctggtattgatgtaaagaaagaagtgtacaaaaatgttataacggtttaaaatatatagacggatgagtggtttcccgctactcatgagaaacagattttgaaacatc

SEQ ID NO: 300 - DNA, 1725 bp, Unknown
  derived from dsRNAs of unknown virus
gtttaaaatacacatttcaacccaaaattgataaagttatttgttactaattaacaaattgatataaatggatatcacgaaaatcccgcaatcatcattagaggcttttctcacacctgaagcccagatacgtagttccggtaatttcgagcgtatagcgacaggatctaaaccaacacctcgttcgcctttgtacaaaaagcaatcagctatttggattcaggaacgttggacagacattctctcgtcagtagctaaccaagatacggtcggattaataacctacgattctactagatggcctaaatttggcccgcaaggaggttttccgcctctcagcgatcgtatggaagatctaagtgcatattacgataacccggtgaagatcgagtcaactctgaaatatacgaaccctactcggtactggaaattagttgaacaggtaagatcagacctgttcggatctcagagagacaaaagacctttgactccacaatctgtgattgatagagatagaaaggatggaaaactaactactaatagtagttgtcccgactattctaaaagaggcctgccagatgtgatcgctaatgcagtggcagatacaataaatggaaaatggaagacttacccaatgatactgggctcaaggtcacaaaggggtaaatacagatttatattcctggctcctttttcattaaatatacgagagaagatgtttctacagcctttaatggatggaatcagaaaacacggaaatcctgctttaagtgcatgggaagggtttgatgatgtagaagcagctatgaatcgccaacagtttttcaaggcgaaacgctttacagcgcgtgattttaaggcgatggacactacatgtggggaaagtgtttttgagttcttttatgacgtaactcacgttttctttcaagctacatactggagtgacttgaaagaggtaatcatgcatgggattagtatacccgtgatgatcagtcttgacaaactggtaaccggtaatcatggaatgttatcaggaagtggacttacaaacattatcgaaacagtagtaagctatgccgttggtaaactcattgaagagatgataaactctgaacttgtaggagaccaagtgcttggtgacgatggtgccttttctgataatgcaacagatataactgatgaacaattagccaatgtaattagagatgcttctttattatttggattagtcgcccaaacggaaaagcaaatcatttctgaccactatacaatttacctgcaacgatattttactgagaatatcaaggtcaacaacacctcggttgtagcaggttgttaccccagcgtattagcactgaactctgcggttaacccggaacgttatcacgacccaagaaagtggggatgggagatggaaactctcagatggatcatgatacttgagaattgtaaaagactcccgtattttaaggatctagtaaaatttgtacaagaaggcgattcttataaattaggtgtcgaaaagccaggtttcctcgataagggtattaataaaacttatgaggaagctaaaactattacaggtttcgtaccgagctacaaccaagctagtcttgatcgaggcattcaagattacgaagttgttaaacttttacgaaacggtctctagtgttagagatagtttaggttctcttagttgaggtaaaaagatgaaaatcttttcct

SEQ ID NO: 301 - DNA, 2491 bp, Unknown
  derived from dsRNAs of unknown virus
gaataatgagtgcctaagaaaataatttaacatagtggaatacgtcacgatagcgagcgagaatttggtgagcttcacagctttcctcagctccaatgagtgaaattaccactattgatgaaataacacttgcacccagtttactattaccttcgggcggcacacgagccgttagagtgccgaatcgtattggtgatgctttacttagactcactatcttgcaggaagatggatcatacataggtgttgatctactaagtgaatgcctgaaggaatccgacttaaataacacgcaacgtactgaactgcatagactagtagcttctagagagatgttttcacatctgaaagatttgggcaatcgcgttgcaacattcaacgtaattccacgaacatcgacaataacgcgtagaggactagctagttcagtcaggaaggaagtagctaggctgaaagagcaatggaacgcaatgctatctgatttacgtgagagtaaatggctacaggaacagtcagatatgacaggaaaggaattcacatacaggacgttagcgggagcccgtttccctcatctaaaaagtcgagctgatctcgctaggttacggatagatgacgcggtgacaactgttcgcaacgggatgagcgttgccatgcaatactcactattcacatcgtttagtacttggagtggtgctgaaaaggcatacctatacgatgatgacgagaatggaacatattcaacaagtgcagcagaatcgcaacacgtttacaatccattagcggtgcgtgttgaaatggatttaaaaggctcaatgaaggatggtttccaacttccattgccaaatcatgctagagaacgtcttgcaaagtacggatttcacgacagtgagctaacgctaaaaaccaacatcgagatagctacattatcgtcaggacgttctgtcccgttacctagaggagaatggccatcatcacagaagaatgcattatcaacgtatagagttacattcgaacttaacgatgtggatattctatttggatcaaacgaagtaaagaacaacaaattggtgattggttgtcacataaatactaaaattaatgacgtgtcgcacaccgtaaaagaatatatcgacgtattgactgcacgtgaaaaacctttgaaggtatttaacatctttgtcgtaaccgtcatgatgagggaaatacctcacaagcatcatggagtgagatgtaccggcctccctgtaatcccatcatacgtaacatcagtggacagagagggaaagcacgttataagagggataacttcacaaaatgacaccaggtctagagatgacttaatccaggagcttgagaaaaacctcatcgacactgaccaatggattaacatcaagaattcagaattgcagaggtttatgggttctaatccaaggatggcaactttaccgcgcataactcaatgcggagtggagtttgctgacgttgaatggatacgtagtaaccataaagccatcttcgacgagttgaagcatgttggtataaatatgcttttgaagcagatgagggcgtccttatttgagcaaccacttacaattgacgacgtatcgtcaatgtatgaagagtattacgacgagtttagtggaccatcaattgtacattcagaggagatacgatcacctgaaggagagctagttggagtaaaacccatagatagctcgctattactcgtgagaatagtattatccactatgttaaacgtcggcgtaagtgagtcagtgcatgcgcacaatcccacaaacgctgacacgcccccattatcacatcacctactaaaccaaaagcgtgttgaatctcttttaattcctctaagtgtaactaaagatcaaatgctagtgtattcgctatccggtccagttgggaagcttttaaaagatgtaaagggagatgcggttaaacggagcagactcggtgatattatatcattaagctatgatttcgaagaaggactgccagaattccagctcgcatcagctcaggcagtcttcacggtcacgtcgccgattgctttggttagtaatcattctgagaaaggatcgctaactctactatccccatctggattagagtttgacgtgtccccaatagttgatgaaataatctacaaacttaacacatccttaacgcgtataccccaaagcagagctgtcatatcatggcatcccttgttttgtattatagtggtagtaacgccagcgaagcacaagcttttgagctttcaagccgtgattttaccagcaaagagaaagtcatctatcgcttcgagttatcataatgtcgatgattcattaagtatactatcgggatcagaaacacgtgttcattacgcaatgatgcgtgaggataaaggtttcgcatcagcgttgcgtacgtatactagtatatatgggcggtaacttataacaattcaggatccacacactcaggaaacatc

SEQ ID NO: 302 - DNA, 1045 bp, Unknown
  derived from dsRNAs of unknown virus
gaatattctcagaagcaatacatctttgtacaaaatgtatgacgccaaaagtgattatgatcagaaatctggtgactcggatatgagtcataaagttgaaatgaaggaaatgagggatatgcttgaaaaactaactggtgataaagcatccatcccaactttcttcgatcccaaggatttagctcaggggacgtacgggcctcatatcgataagtaccttggcagaagcccaagcgatggacccgcaggttacattttccaaaaggttacgtactcagctggagcggtagcatcgaagactaacgtagctggtatgtacaaattgtcgcccgatcatatgggttacatttaccatgacgccgaaactggcacggaggttcgtatcaacggtgatggcgccgacctagcgggctctgcggatcccacccccgccggtatctcaggtgaagcgaaattggttcccggggacatgatccttggtgcgatcttgcagctagttgacactaggtcgtcggataacaggactggcttcgtgactgctggactcgtctctaatgattcagctgtgcctgatacctatggtcccgaattggccaacgatccaagtaatttcattactggtagtgcgatcagtggtggtaggacacatgcggcgaatggattaaaagcttgctcagttgctagccctaaccttaacatttacaggcctttcgttgtggctacggccgcgtcggatctgctaccagcttatattggtgccccgattagcgcaattaacgtctcgggatgcaccggctcaacctctagtcaaattagatttgttctgaacgtctacgccctagttggtgcgaggcagaaaactatctctcactacacgcaagcggatccttcattcaagatggagtgtctgacgcggcaactaacggaacacccagtttccatgatccattaatttactaatggtgcgtgatacatcatgaactaagtatgtacggcttcaaatgcggtgtgtcaagccgggttcacattaatgagatgaaacatc

SEQ ID NO: 303 - DNA, 2096 bp, Unknown
  derived from dsRNAs of unknown virus
gaatataatacctaaactatttaattgagtaataacgataaataacatatttccatgtcgattcatgaaagaaccaaacgatacgctgtggaggttgcggaagcttccctgaacgcattcgaaactcaagctcgtggaacactcgaggcgcctagcggtgatgaaaacgttcgcctttatacggcaaaaggagggtcagctgtgactctgtcaagcactacgagctcggcggccgttatctttgatccggaatctacgctgcggaatggacagactgcagtgcacatctatgaacgcaacagcgctggcagcgtgatcgctgcgcaaacggtaaatctgggacgctcgacttccgagttcatctctgccggtgtgttgtctgctggtatgaaggttttcaactcctctggtgtggacgtaattgggggaactcaatctcaggccgtcctgacggctgttccgcgagatatttctaccattactacaactgacctatcgaacttctgcccgaatcaccaacgtgacctaatctctggagtaatctcacgtgaggaagcgtcgatgactatggcaatgacggagcactttggcaagaagatggccctgtctcgtagtaacatgattggtaacacggtcaagcgttcatgggatgactctcttggaacccgcagaacaacagttggagagacgttgggtaaaactgtggacaccacttatacgctcccaacaaactctgagaccgacatcgctacatacttgacgaccaaaactgctttagtgttcgctgattctaataacctgacggaggcgaacaacccacttacgttcgctacatacaacgttgactttgatgcatactgtctggttgaggacgcgggcgccactcaaattaactatcaggtgaaggtggctttaattggctatgactccgctaacaatgttgttgccagcgccagtttgaacgactacaccactacctcgcaagctggaaccgcggaccgatatgaccttcaattcaggggatccctttcatccagtacgcggccaatcactcgtgtcatcctcgcgtggaatacgaataacggtgctagcaacgcttctactgagcttgccgtctctgagaccgtgtttaagttgacgggatatgaggagactagcgatgtccctgctcgcgccgtccaagtatgcgttcttgagggcctgaacgcctcagcaactctaaacatttccagctacgcagtcttaactggtgtcccagactccactaacacttttatttctgctggtgacacgcaagacgcagtgtatgataacaatgctgttgagattttcttgaaatccataacacgtgtgatgccacgtgctttcacgacgaggggccatagcgctgtgtctaagacgctctcagcaatgtatggtgatgaagtaattgacatttctttcaaggcaatgtctttcagcggagtatctcaagctgtaaagcgactttctaaacttgcaaaggcgacaggtaaggatgttgcttcactgctagatgacattgaccccgccgtccacgcagtgggtaggacgctgtctgccatgcctggtcctgctggtgctgctggatctgcgatgatgcttggatcagatgcatacaggatggttcgtcgttgaaggatcggccatttcccaagtgtgatagagatagatggaaagctactgcccggtctatcgcatgacattattgtgtcaacatacaaaattgaaggaaagaaatacacgttcataaatgatgtatatattgacacaaatctgataaatgctgggagaccaatcactgaaatggcaaaacatttttccatgagtcatctgacattacgacgagcgctgaaaatggaagggcgatcttgggaaatggcagcagctaaagcaatgttaggatttgggggaatttacagcggaaccgtggaatcattctctgaaaaacaagtgaagtatggcccggtaccagggatcaccctaaaggaagcaataaatagaaatcttaaaactaatatagatagtccgtacgatttactttcccggtaagtagtacttaaggtatttgaaacatc

SEQ ID NO: 304 - DNA, 2464 bp, Unknown
  derived from dsRNAs of unknown virus
gaataatgagtgcctaagaaaataaattaacatagtggaatacatcacgaagcgagcgagaaatttggtgagctttacggctcttctcagctccaatgagtgaaataaccacaattgatgagataactcatgcacccagactatcactaccatctggtggtacccccgccttcagagcaccaaatcgcgttggcgacgctttgcttcgccttaccatcctccaggaggatggatcatatataggagttgatttgctcagtgaatgcatggaggaaagcgacctaaccaacacgcaacgcacggaattacaacatctcgtgacttcgcgaaaaatgttcttgcatttgaaggatttaggcgatcgtgttgctacattcaacgttatacctaaaacgtcgacgattacacgtaagggattagcaagcgcagtcaggaaggaagtagcaaagctaaaaacggaatggaacgccatgttgtcagatctacgcgaaagcaagtggctgcaagagcagtcagacatgacaggcgaggagttcacataccgcactctggccggtgcacgctttccacatttaaaaagtcgggcagatctagctagactacgtgttaacgatgtgaagactgaatactcgctattcacatcatttagtacttggaaaggcctagaaaaggcgtacatatacgatgatgacggaaatggtgcgtactcaaccagcgcaaaggactcgcagcatatttacgagccattaactgtagacgttgagatggatttgaaaggatcacagagagatggattccagctaccattacctaagcatgcgagaaaacgcctcaagcattatggttttgatgaaagtgaactaacgctgaagagtaacgtagagacagctatgctatcatcagggcgttcagtgccatcattcagggatgagtggccaaagccacttaaagctgaagtggtatcaacgtataaagtcacatttgaacttaacaatatagatcttctattcaagtcaggtgaaataaagaacaacaaaatagtggttagctgccacatcaatacaacggtagataaagtggtgtacacactaaaagagtatattgatatactacgttcgcgagggaagcctttaaaactgtctaagatatttgtcgtaaccgtcatgatgagagaaatacctacagaacatcatggtgtgagatgcactggactgccagtgataccgtcatatgtcacttctataaacagagagggcaaacacgtcgtaaaggggatatcatcaccaaatgacaaaagatcagtagacgatttgattttgactctcgaaaaggatctaattgacactgaccaatggattaatataaagaactcagaattgaaaagattcatgggttcaaaccccaatatggcaactttaccacgcataacacagtgtggagttgagtttgctgatgtggagatgcttcgtcttagtcataaggccatattcaatgaattggaacggattggcataaaaatgctattcaagcaaatacgccggtcattatattcgcaaccactaacgtttgatgaagtcaaactaatgtatgaagaatattacgataaatttagtggtccatcaattgtacactcagaggagatacgatcacctgaagaaaagctagctggagtaaaacccatagatagctcgctattaatcgtgaggatagtactatccactatgttaaacgttggtgtaagtgaatcaatgcatacgcatgattctacaaacgccaatacacccccgttatcacatcacttgctgaatcaaaaacgagttgaatcacttctaattcccttaagtgttatgaaagatcaactgttagtctactcactatccggtccagttggaaagctgctgaaggacgtgaaaggaagagcgattgaagaaagcagacttggtgatatcatagcgtcaagctataatttcacagaagagttatccgtttttcaattggcgtcagctcaagcaattttcactgtcacaacacctattgctctagttggcgatcgttcagaaaagacaccactaaccttactatccccatctgggttagagttcgatgtgtgtccgataattgaagagatatgttataaacttaacaccttctcaactaggctacctcagagtagagcagttgtatcctggcatccgttgttctgcatcatagttgtagcaacgccagccaagtatggaaagatgagttttcaagctatagtattacctgcaaaaaggaagtcatcaatagcttcgagttatcataatgttgatgactcattgagtgtactatcaaactcggacatacgtgtacacttcgcaatgatgcgtgaagacaaaggctttgcttctgctttacgtacgtacgctagcatatatgggcggtaacttataataatataggatccacacactcaggaaacatc

SEQ ID NO: 305 - DNA, 2131 bp, Unknown
  derived from dsRNAs of unknown virus
gaatattatactattgagataaataactgaaataaaatactttataaaatattaataacagcttaatctttattcatgacgatcgttaatgataccaaggattatgccattaaggtggcatcaactgcgctaaactccttcgaatcacaagcgcgtggagatatccaggcaccgaatggtgatgacaacgtgagaatgtataccgccaaaggtggctcagcggtcactctgggcagtagcacaacgagcgccaccgtcgtttttgatccagaagcatccattaggcaaggccaagctagcgttgtcgtctacggacgtaactcttccaatgccgtcatcgaggttcagcgagtcacccttggtcgctcaagcgacgaattcctgtcagttggagttctaagctcaggactgaaagttttcaactcatctggtgttgacgtaatcggtggaacgcaatcggcggccgtacttacatcagttccgaggaatgtttctattttgtcctcgactgatcttgcgaatgcatgccctaatcatgagcgtgatctagccagtggcgttgtttcccgcgaggaatcgactatgacgatggctatgactgagcatttcggaaagaagatggctctatctaggagcaacacgcttggtaacatcattaagcgcacgtgggatgatggtattggcactaggcgaaccacggccggcgagacgctatcctttttggttgatactaacctaaccgctacgacgactgacctaactgatgtgcaaatcttgggcacgcccggtgacccgacaagcactggaactgcgactgcccaagtactggactccgcgcgtttgagtgaactcaataaccctctaactctcgcgacctatcatgctgaaattgaaatgtacctggatcttggtgatcccggatcaagtgcacttgaaaacacgaaattcgagttcaagttgtacgccctggacgctgcggataacattattagtgttcgacgcattaacaggcgtgaggatcttaggaacgcgaaatcctccggtgtaactgtcactggatccgttacgagcactacagtgccaatttcgagggttgtcgtgggacttgtggttgttggtggagctaatgtgaatgacccccttacagtcgttaacacttcggccagactaactgcgtacgaagagactgcagacatcgccgctcgcccaattcacgtttgcgtgttcgaaggtcttaacgcttcggcgaccattaaccttaactccacggtagtgctcacgggtgtccccgactcgaccaacgttttcatctctacggctcaatcgggtgacgtgcccgtgtatgacaccaacgccgttgaagtgttcctgaagtcggtgtcacgttccctgccgcgagcgttcacagttagtggtcatagtgcagtgtcgcgatcgcttgatgccttctatggtgatgaagcggtctcagtggccttcaaagctatgagtttttccgatgtgcaaaagggagttcaacacgtggccaagcttgcgaagaagtccggttctgaactttctgatgctcttcgcaagctggagcctttcatgcgatctgttggtacgcccatgtcagccctgcccgggccagctggtgcgcttggcggaatgatggtcgctggtgcggactatggaaggatgatgcgatgaaaaattgggtactttccaagtgtagttcaaacgcctgatggatataagccaggtagactgcattcaattattctcagcgacatgccattgaaccgtaattattacactaagggcgtaatccgtattgatgagaatctaagaaacatcggtgacgatattttaaacatgatgattgacaataatttaaaatacgcctctttaaagaataataacgtagtagaaggtaggtcgtgggaaatggcggcagcgaagagtatgttgaatgagaagggagtctactccggtgaggtaatagggtatgatgcagcgcatggaccgacatacggtaaagtgccagcaatacatgtcaaaagacaagtttataaaaatgtaatttcagtaatttaaatcaaaacatatgcgtcctttcccgggtcactaagtaaaggtatatgaaaacatc

SEQ ID NO: 306 - DNA, 1490 bp, Unknown
  derived from dsRNAs of unknown virus
gaatattattgtacttatagaaactgtaaacgctaaatatatgtaagtcattataaatggagcgtaagcgtaatttgataagacattcttttaaggatggttcacgtggcagaaagcaatctgggcctacctccgcgcccccaccatcaggtggtggaagcggcgtaacaccagttgaagaagaaacaactattgagatagttgaaccggtggatgtcatacgtgataagacacctgatgtaacccgcatcatagacttcaggggaacggaagttccaaaagacctaccaattatgatgtcggaggaagacttttctaatatttccagcgagggtggcgctgattcaacagatgagtacgaagttgtccttattgagactaggcctacactactccccgatgatgtcgatagagatatcgtacaaacgactttccccggaatggacgtgagctcaagtaacgaattagcggacgtaatgatatcgactggagggttagttgctgctcccggtatgccgaaaccgaacgccgtaattggcttaggtattgcaaaatcaggagatatcataaaatcaattaactctggagattatctgggagctgtgtatgatgcatcaccaatcttaggattaacaatggatgagcaatctggatctattgatagattcgtaaacacagcaggattggtaggctcgcttgtatcaggtgatttcgatggagctggtaacaacctttcatctccctctagtgacgcagaagaaaggaagccatcggagcacatcggcatcgtgttagattcctttggcggctatggcgaatcacttggatatggattttctactggcctttcaaatgttgataaggctggtagcggtctcgagtcggctggcagaggttttttgaacttatttagtgcggcgtctaaatttgatagccagtccgatatggtacggagcctaccaggtattaggaagattgaggaagatagatattacactgtattcttttacccacgtaagggaataacctatatagagtggaagcccacagaagacgtgcgcaatctgttctctttaaaaagattctcgacgacgatgagagaatggagcgaagatttcatagcggcagctggcatgaaagttcctgcatggtcgcgacgagtaaaatatattaaagaaaagtacggacccgagagcgataaagttgtgcattacggatactcgagaggtggtggcctagctactcatctaggtggaacgggttacggaactggatacttctcgtcttatcagccaaccaagaaatcaaagagtaagttcagtggtgatttactccatgacgcaattattaacccaatgtcgtatatgcttttgttacgaaagaaattacgacctttttaatactaatgcgccgataatatgcatatatattttaaagtttaacgcgctattctagctagcgtgatctatatttgtgcattatgaaacatc

SEQ ID NO: 307 - DNA, 9835 bp, Unknown
  derived from dsRNAs of unknown virus
gaattttaattttaggcttataaagtctacaagcccgcgtaaatacgcttgttcaattttaaaattccagtgtaaagcgagatcggcacatacgtgcgtctgacaactttagactgaaactcgttcacgcgaaggcgctgcaatagcatgtaggttaccactaagtggcaagacttggctattagtgagcgcgctcggaagaacatcttgattcgaaaatggtggtgcgcggtccattctagaaacaagggactacttcgagaagacacgaaatagctgaacatcgaaagggagggagaacgtaggtcagacttgctcttaatctttcgataattaggtaaaacttcgttccataaatggcaatttcgccacttctaaggagaaacttatgtctgcattgatcggagatgttcacatttctcgctctgtgttcaaacagattgaagagattcatcaacccaacgacactgtgaggcctactgccaaacagatcaccgacatgatgctcaagaatgtagtgagggcgtttatcgacgcaaaagtcgacgaacacaagtacttcgatcctgatcttttccgggctcgcaaagtacccggagagatgaacgactacgttatctatccgaaatacagtggggtggcggactggatggaatccaggttcaccatacccgttcgagtggtaatcgagccgtccaatcgtcacaacattattgatcgtgacaacatcgatagtatgaagtctgcacaaaggctgctattcaaattcggactgtcggctcgcgcgagaaattgtctctttatggcggacgttttcgcacttgatgaactgcagaatcttactgtacaggagttcgttaatacaccaaatgtggggcataaaacgctgcaggagatcaaacaggccatgtgccgattcgatattccgttctcgaaggagagaaagtacgtacctaggcgtactagcctccctcacaaggatatcaatggtctctgcccaacatgtggaaacgacgtcggacatggcacgtgtagtgtctcgaaaattgagggaatcgattgatgaaaacctcggcattcgaagaaatcatcaacgtcatacctggtcgctgcttcgtctccgacaagcggaaccaattgggtcacgacatctatctgaatgtcagatccactccgactgatcttcattttgtgcgtcgtttcaacgacgcacttctgcacgtgtactgcgaagtctcgagccactcggacatcgagaatcagtttccgacttaccaactaggtaaagttgaaattaaatacacgtcgagaggtcaatgcccgaaggaggtacgctcagcgacgaacgccgagcgattaatcttcattatggctaaagacacgattttcaaatccttggggattttcgcatgactagtcgagttttgcatgaaatatctgaagaacacgtagcagagattatctctgctggcactacgaccctctttgtgaactcaggcggtggtgatattaactctgcacttgttttgttacactattgtgaacgtaatcaagtaaaggtgatcatcgccggtcagtgctcatccgctgcctgttatctcctcgctttgtcacgccataacgtcgagataaagactcacgcatacggcgtgcagcacgcaccgtcaactctgcgagacccgcagaataactggcatggtttcgatgattgtggttttaaggctgctcatcgacagtggaatcaggataagaaggtgtatgaagaactacttgatcgcgagatcagcgatctggacgctttcaccctattcgattaccatctcgcaacactcgtagacgagggtaatctgaggaaaatctacttcggagatgatgtatgctagttgtgcattgtcctcccgcatccgggaaaaccttcctcaccaagaaataccctggtgttgtttacgacaacgatgaccttctggaagacatcggactcgaaagttctcactcgggttttcttgccatccaggatagtaagaattggcaaacgaagtggttggctgcgtttaacaaactggaaaatgacggcttcaccattttcacaaccaacatgaatgtacaacacctgtgtggtgtgcagatcaatctgcgcgctgcttacaaaccgacggactacattcgtcacgtcgaaatgagtggacgtaaggacctcctcctcaatttcggtttcgacgaactgaaatcttggatgtccgactacgtttccgccgaaaaggagttcggtcttaaggtgcactggatgaaaccaggacacttcattgacgaactgatcttttaatctgaccgaataacatcaacgaacgggcatcgcccgctctgcggagaaaactatgcaacacaatttgtgcacaaccgttttcacgatctcgtatttcgtcgactcgtacagtcacgttatcaaacatcatgactctgtagcacgcaccagctacgaagccgagatcgaagtaatcaatcacgtgttcgatgaattcgacaccacacccatcatcgttttcgttgtcgaccaaaatggtcggcactacaacaagggggtgaaccgtgtcgttatttgagctcgaaagagacacctacgtcagcctgattgagctgcttgaactggtcgtgttccaacggaaactccagtttccagacattatacgattgcagaatggctgccatccgattatcgatctgcagtttaccgactgcgggcaatacgtcgatatatcctggaggccgcatgcttaattacgtgtttaaccacgcctttctcgtcagcgttgctggcaacggagaggatttcgtgttctacgcgcgactggataatcaccacgtcgctcggttcaactggcactcgtcggaacgaactgcgagcgtagaagtacgcactgaacgtgtgctcccacacgtcggtgacgctgttgtgcagctaccactgcaccaacaatctgtcatacgacgagtaatgcacatctattcacaacgtttcactagtaattcggtagcgaaagaccacaatctgtgggttcgcagcgccggagattacagtgaaggttcaatttacctttggatgtagtatgactaagcacgttccattagtatgttgtttggacaagaacgcggtacccgactacctcattcgtgaggaaaaggagcccgcccccaacttagcgacagacattttaaggaagtttctcgatggtactccctccaacgaaagacaagctaattcacaacgctgaattaggtgaggcgttccacgggccgaattccgtcccgaaacatattctggaagatacaattggtaaaggctgcgccaaagtactcgtccggaaggtcaacgccttcaaacgtttcaaatccaagtataaagccttttcttggatagacaacgacaccgttttcgataacctcaaccatgcccgattcgagctggaggacatcgatccacggttcccatccgtggtcacacacggagcattccgacaacaaggtgtaggagttatccctccaaccgcaccagctcgccgagaattggggcttatcgatcctgatgacgaccatcagacgatcggcggtgaaaagattgattcactgttcaacctatgtctagatctcgtcatcgacgaattgagactcggacctatactggcggagcagcagcaaggctccgacttacgggcacacgtcgtcgtcaagaaaacgtcgatgaaaggccaccctatgtgttacactggacaggccgcttcggtggacttttcacgcgacgtactcgttccgatgtacaatagcaaggaaggtccttacactttcgcgttcaaagacgactactacatcaccctgggaagccgcgaccaggcggcaaaacaaaaattcaaggatggtgagtggtcaacgtcgtacaagttaggcgcgagattcgacagtaaggacggtaacgcggtatacatggcacccatgtatgatcccgatgataacattggcaaccgcgtccgtcatgtcgcgaacgtcccaatggttgttcaactgccgggtatgaccgctaacgctttcgtgttcgacaatttgacacccaaaatgcagatgattctgaagcatacacccgattcgcttcagaccgtcataggcaacatagttcatgcgacggatttctcatccttcgacaaaactattctacggaagtcgcggaaccggttttacgatcgcatgtactcttcggacaacgcaactctcgcgaagcagattgacagatatccgttcgcaggcgtgtatactgagcacgatgcgacacaaggcaacgaagatggtacgataccaatcttctaccttatcgatagaacaaaagatgatctggcggagcttttctctccgttggcgtctggcacgggtgacaccgcactgatcggtaaaacgattggcacggctaacttgttgcgagttctgtcaatcctcactaacacacaccccgctaaaataatagcggcaggagatccaaacgcaatcgattgtctagcagcccaagcgattcgtaattcgggcgatgattctcttacgatcatcgaccccgtcgccaaatttgccggtgtgaaaccggaagaaatggccaaacgtcacgtgcatctgctcgagacacagtcgctgttcgacctctcccttgaggtaccagcgaagttcatcgggtacgtgttccacgctgacaactccgtgacgggacgttgttgggcagtgacacacgacgtgacctccctgttcgcaaacaatgttttccgtgaacatggtttcgactctccactgcgttcggacgaagtggtgggattgtcgcgttctattctcgcgtaccggtcgaccctcgacctagttatgcctgctgaaagcgatcgtcttgtcagcacactcctcgacgtagtagaatgtccttatgacgaggaatcgttgcacgcggagggcacggaacgacttgaaaaccccgagaagtatcttagtcgacgtgtaaatgaagaacttgtcgaagaggatgacgattgggacctggaaagcgtttccgatgaaatgaaagccgagtacgcaaggaccaaactggctgaattcttcggtctttcgaaaccggatgaactagactggaagatcgaaaagaaacggctcattgaggaatcgccacccgatcttctgcagtacatcgcaattgtcgtcgatccgaaattgacgactggtgtatccaaattcattaatgtgagattctaattatggcatttgtagtttccaacctctcaacaactatggccctcatcgacagcatgctgggttccgtatccaacagtggccgtaaaactctggtagccccactagcaatccagcatcatcttgcccacttcagtgagcacatgcaacttttcatcgacaccatcgtcgaaggatatcgtggcgcatcgacgtcgaatgtcgacaactccgagttgctacgcgctaccctgaccaaccatattctcgaggtttactatcccgagattcagaagttagcacctctcattgcctcaccgaccaatctgggtgcgatcctggaatcccatgatcccatgtgggaggtagaaaaaggggaggacttcccgttctttaaaacagtacattttccgcaactgcgtgatttgcacgcgaacatgcgctcaatcctggaaagtgtcgacgtgactaacggtctgcgttacgttccgtcgtactatgcacccaagctgtacgcacacctcgaaaaggaaatgaagtcgcgtcacagtctcaaccagaatagcaagcgtatcaaacagctgggtgcgcttcttggttcggacattactgaggaagagctgacacacatcaatcaggcactgtcgcgtttgtttggtgagctcaagaagctgtccgacgctcacgccgtcaccaatttgtgggagttgatgattctgacggatcgtgcggtgtctgacacggatcagcccatgttctgtgccaccgacgtacacatgcgtcttatgcacactgcgttgtctatcctgcccactgaggtaggtgtagacattccgctcagctacgtgaacaacagcgatttgcccgaagaggacaatggtgttacccgcaccgccgacgcggtcgacattgaagagggtgtttccccgatgatcggtgacgtgttcgaacacctcctggttatcgtgggtcgcaccgcgaagcgtatgtccgttcgtctgaatgacatcacgctcccggtgaacatccacccgatctcaactataatcacggatatcttcaaggaaggtatgcgtgaactgctgccggacgttcaatccgaatttctgggccgctggttggatcttgcttcaaagggttcaaagactcccgtcaaatatgacgacttcaaagtcaagatggataacgcactgcacgtcgatcgtaacgcaattccgcgtgcgttcgacgaccatctgtttaagatggtaggttcactgcccgaggagctgatccggaagtacgttgagaagcgctcagtgtatacgtcgatgatcgaagccccaattgagaggacgttgctgcgtgtgaccgacagtatcgatgagatccgtgacaccgcgcgtgtccgtctcgaatccgatcaaccattcgcgtggtacggtgacaaggtaatccgcaaacaaggttctacgaacgaagcattcgttctgcggagcaagatcgactcaaacatcgccgtagacggcgagatggcagagggtgttgcgaaaattgtcgccgagctgtacaagttgcgccaacccgatcgcgacgacatcgataaggaattcagctacgctgaattcattcgcaatctccgtcatgacctgggtgatgttcgtcgtatcagggacattacggctaatggtgacaccgagctgcgtttgtcaaacgtgttacggggaggtgaatttcagtacaaggatgatttcgtcttgttccgtgaacatgggcacagtcacgaaatgtccatgccccgcactatgatcaggctgcaccaagattctattatccatgactaccctaacgggagtgttgcgtatggaaccatttccggcatgctggcgagtgatctcttctctcgctgggccggtaccattacttcgttggcctcacgtgtggcacgcgtgtactccgctgcacctttcgcagaagtatcaaaagatctgaatattgtcacgcaatatcagagcacgtcatatctaaaacggagcaccgaattcagtactttctactctcagatggacgtcatgaccgacgacagcgtgtggcgtttcctgtctgcaatgcagacacagaaactcgcacgcgataaggtcgacgtggaggtgctagagaaactcaaacgtcacgaactgtttgtcaacacctcgttgttgaccgacattgccaactacgcggctagcgtagcgcaaagtgtcattgataacttcaatgtcgaatcagaaggtttccagacgtttgcgaaattcgtcgccggtcgcttgactgatgccgaaatgggcaaaatgcgcgatccgcgcgttttgacggttttcaactctctcgtcaccgtcacattcgaagctctggagaagaaggatactattatcacgctcatcctgaccaaggcgcttatgaacgaaatcactagcaaggtgaaataatgaacgaactggcatcaatttcgattgaaaccatgataccgcgcgctttgcgcggtttcggtgccatcaccgtctccggtggtggtggctccggtaagacgtcactcgctcgggccatcgggaatgacctcgaggacccggcttacaaactgccttttgagtttgctaaagccggtgcactgttggggtcggctaagctgtcctcgaccgtctttgagttcctcggagtcttcctttctgagggtggacgcaaagtgctcaacgccgtggaccccgatctctacacaacggcgatgactgatcttgagaaagtggcgcctgagatccgtaatacgattcgtgtcgaagtgttccgcgcaataagtggagccttggcgccggagcgtcacctgacggctctcgcaatgtcgttgcaataccatatcctccgggagatgggtacggtgaaagacgtacaacccgtgaccgacgacgaaaccatcagccaaatcatgaagggtttcgaagacagtcagctgactccacaacagattgaggatctgcgaaagaagtttaccgctaactccgacgtcgcaaccgatgaccgttcgtcaatcgatggaagtctgggtacgtcacaagcggtgctgaaatggttactggacagcatcggtgacaacagtggcgtgggtgttaacgcactcgtgagttgggcgcttgaccacagggacttgatcgttcctttacaatccaacgcacttatcatgacctacatggtgagcaaagtggcgatacccattgcgactgcgttaaatcaacggtttggacgcgtcgtggtcatgcggaacgaaaagatgatgcgggatcgtaaactcgaactcgttgtatctaacgagagcagacgtcatgtgttgatttctgcgatggttgacggcgtggagatcagttccacactgacgttcgaacctatcacggtagcgcgtggtttgtcattcgcgttcaatgttcacctgagtacgctgaactcagcctacaccaggcacatggaatcgacgactctgtctggcggtttgccaaccgcaatacccgacgccatccaagagttgaacgacaccggtgccgaaattggaacgcgtttcctcatcgaaacacgcgacgatttcgtcccgaaacacgccgacgcggaggaaatggaaatgttccgtaaccgcttcatgtcctcgtctcgattctcgttatatctcgcggatcgttcgggtggtatgtggcgctcgcgtcgttacagtaacagtgatgaactgaacgaccaacagggttcattccgcaaccacttcgacacatacgtcgcgccgcgcctcgtcaatgaggagcaggggcaagacgtctgggccgaattgttcgctatacaggacaagaaatgaatacgactgtccctgataacgtaaagttacgaccgactaaagcggttgtagctgcgttggcgtatcgtctgagggaggaatatcccctcggacacaaacaggccctcgactatgtcgcgagacgtatgggttacgagggttacgatgactatctcgcaaacagcggagtcaaagatgaccgataaactcgaagaactaatacgtatcaagaacaaacactatgacacgtggggtgattttaaggatcacgtcagtgccatcacgcaaccgccgattggtgtacatggtgaacgtgaagtcggacgttacgcgtctatcgccacggaaaccaccttcggtttgtcattcactatcagtgaaatagacgaggctcaacgtcatgagcaaaacaagcgcaaacccccccgagtcgcaaaagtcaaggcagaacgatctgctcggacagctgcaaatcgcgatttccgcgctcggtaactacacgacacgacgtgcccgcaacgacattgttgaggggtacgttcgtatcctgctgttgacaagcggggtggtattcgtttcgttgagcagtttcgctgtatatacgcagttcataggatgaactacgttcgtcggtacagacggatatgatggtatcgtgcaaatcgccgctcgagcgatatactcgtaaacctcacatatttattgaattttatttaactgcatttgcagtcgccttattaaaggcgggcccctaggggccctttc

SEQ ID NO: 308 - DNA, 2089 bp, Unknown
  derived from dsRNAs of unknown virus
gtataaaacatatattttaaacactattaaattagttttatcaaaattttctgttcgaaacttgcatgttagaccagaaatccatattctgttgctagtgtcgtccaagatacactaagtcaagtcactcaacattacatatattaacataggaattaaataaactatggaaagaaactcattagatgatatttcatcaatgcgaggtggattcatgatcaaccctccgggtacatctagaatcccaagaacaagaattggaacaaacacaggcctaccaccagctcaggaactaccaactaaagaaggtaaatctgtccctgagtcggatcttagaactaaagcgtcttctaagactcaaacaaaaacaaaaggttttaaacaacctacggctagagccacgaaaacagctcaaacaaagagctcaccaagtcgacaaaaatcaggacgttcgcaatcgcgtgccactactgttatgtcggccggtagatcgtgggttggcggttacggcggtaaacctccaggtagtcccgaagaatccggacaaccaggagatagttttcctacaggtgaagtagaatacctaggtggaccacgagttactactcaaacctcaaagttcgacggtatatctgaaatcgatcaactagaccagaccgcaggttcatggactggagatccttctcaagtaagaacactttatcaatcattcaatttccaaccatatccgaactacggcggtgcaatcgccggcatgaagagttcaggtgcaacaacgtttgcaacagcctcaactactcaagacgagatatttttggatacctttggtgctattcaacaggaatacagtgaaaattacaatgctaacacagtatttgaacaaaatttcaaaccagtgtatttctactattatcaatttgatgttaatagattacatgcagaatatgtttgcttattacaaagagcagcatactatcaaagtaccggcactgagtatactgagaatgcttgtgctgaaaagatagcaaatgtattgaatacaacaaatttctatcctattcgtaataaaatggcgcgagctttaaaacgccaatttattgacagagagatgcgagacaagcattacgaaatctttcagactaatcgtttaactccacacgaaacaggtggtacaatctttaatgttaccgatgcaatggcaacattattacagaatttatcaaacgccgcagatttagcaacagcgcaaaatgtggttgcaacttatatagctcaactggatacaatgtgtgactacttactttatggtcgtcctattcagactgatacttcagtgagtccgtcaaaaacaattccagactacatgatacctaaacgtgagttttcgggaacattatacaatttatatactggttccgaccctgatactatttactcaactgttcgtagaaacgctatgagtgcgattcttgatcgagtttctggttcacgaggatcatttgactatgttaaattaaattaccaagctcgcggtaattcaatgtcattatacgactcagctttctgtgatcgttataacaatactccaaatcgaaatggaagtacgttctaccctacaatgttgaaaggtagtactactgtgtcaaaggcggctctttcagcatcgccgtactactgttctgaacgtagtgcagacaaccaagattgtgatactgtattccacatgttattaatgtttaatggcgaatccccattatactattcaaactcgagaatcacaagtttcacaacaagagagtattttatttaccgaggaagaaattctttaattggagatgaaaacattgacttagcttacacagctaaaggaaacatcacccaagtaggtagtaatgcatttccaccgattcaagataactatgttactaaaacctatttcgatggtagtaacatttatggtttctctgctcctgacggagacagttcaccattatacttcgtaacttacggacgagttatcgagaaattcaaacaaaagtatatggttaataaataactacatcgcctgaaaacatcttgttttcaggtc

SEQ ID NO: 309 - DNA, 953 bp, Unknown
  derived from dsRNAs of unknown virus
gaatataaaaccaatcaaatttttataaataataaaaacataaggaatactataatgagtgttgctgagaagactaaagagtacgcccaaagtgtcgcagatgcggctttgaacgctttcgaaaggcaagcgcgtggggacatccctgcgcctagtgcttcagaaggcgttcgtcttttcaccgctaaaggtggatcagccgtaaccctggcttcgaccactacttctgcgtgtgttgtgtttgaccctgaagcgagtcttagaagcgggcaaatgcgtgttcaagtgcatgagcgaacctctgatggcgccgtctcggccacgcagaatgtttcattaggccgcgcatccgatgaattcttgtccgtaggtgtactctcctctggcatgaaagtattcaattcttcgggtactgacgtgatcggtggcactcaaacggctgccgtgcttacctccgttcctagagacgcttcgacggttaccgctactgacgtggctaacttttgtccgaaccatgatagggacttggctagcggcgttgtgtcgcgagaagattcaactatgacgatcgctctgtctagccattacggtactaagatgtgcttagctagggggaacacttctggtaatgtcgtacgtcgtacttgggatgatggcgttgattccaggaggcaaactaaccagtttagccttggtcctaccactgacacagcgtatgatgttcttaacgacggtatccgatcggacgcacaaattatcgctggtacaaccacagctaatggagctttccctggcgcaaacatcattgacagtgacaacctgtccaacgctaacaaccccctcacactggcaacctactccgttgagttctctgcccatatggtgtggcttgcccctaacgcttctgacacggattacttgcaagacctgcgcgctctggctcttgattcggc

SEQ ID NO: 310 - DNA, 1117 bp, Unknown
  derived from dsRNAs of unknown virus
aaaatccatccgtactaccactgccattactagtggtcagccgtttgttgtggatgtgtctggtagcattacgagtacgaccgttcctatcgctcgattcattctctccccttcctttgaaagcgtgaacttgactaacttggatatcagcggttcgcaatctaccgcgactctcacggctatcgaggaaactgcggacatccccgcccgtcctattcacgtgaccgtcttggagggtctgaacgcttcagcgactattaacctgtcgtcctttgccgttcttaccggtgtgcctgactctaccaacgtgttcatttccaactcccccgtgatggatgatgtatatgatttcaacgctgttgagattttccttcgatcgatcacgcgcgtaatgcctcgtgctttcaccgttggtgggcatggtgccttcacgaaggagctcactgctatgtatggtgatgaggagatgactgtcgctttccgtgctatgtcttttggagatgtcgcaagagctgtaaagaaggctggaggcctggctaagaagagcgccaaagagattgagccctatatgagaggagctggttccatgatgtctatgcttcctggatctgctggcctcgcaggatcagccttgatgacggggagtagggtagcgcgcgggattggcaatatgtgaatgataggccattttcccagcgtgatcttacttaatggatcgttgctaccaggaagaattcactcgattgttttgtcggacgcacccctcgatagaaactactcacactcgaagggaatatatattgatgagaacttacgtgacattggtgaaccgatgatcaccctcttaaaagattacaatgtaaaatacctatcactcaaacgtgataatgtagtagttggaagatcttgggaaatggccgccactcaagcattacttggaaaacaaggaacgtattcgggcactgtggaacaatatgatagctccacaatacgatatggccatgtaccaggtttaagcacaaaacgtatactatctcctaatgttataacttatgaaaatttagaatatgtgtcactttcccggtgatgtaatatgtaaaaaggtttttgaaacatc

SEQ ID NO: 311 - DNA, 1075 bp, Unknown
  derived from dsRNAs of unknown virus
ggtttaaaaataacttctttttgaagttgagcacaacgcgatggcacatctaatccaaggagctgtgaacacagttttcagagtcccggcagccctaaataacgaagttccttatgactggttgatggtagcacacgggtatgcagttaatgcggtagatttttatcagtatgattccgctgtacgcaatggcaattctggacagttaccactacgtgatgcagcgctacggaagctggtgagtgcgtcggacgtagacatgacgaatgcatgcgaacgattcatcggaatgttacgacgtttgttggcgagtgcgaacgctccgaataatttctcgcgacgtgagctggatattttgaatgaaataggcagaaccgtgagacgtcctaccactaggccactgattatcggtgcgattgatgagttcgtgcagggcaacaaccgacctgcgataacccacaaccactgtcaagatcatgttacatcgattccgggtattcaagctggcgcccatcccatgacgtatattcaaacgcgcgtacctacgacgttcttcagtacaaattgttcattcgacaataacgatcaaagttacagcgctcgcactggaagagtgaatgtatcaccaatagctgctgaggctaaccgaatttattacatccattcgactgctatggtggacatatcttctacggtccgtgaggcgcttgtgtccgctggagtaagatattgtatcgcaaacagcgttgaaccatacaatagagcaccgttaccactttggttgatagttcaacaacgattgcaagcgtattgggtggctggtccagcagcgacgtatactcgtttgatgacagcgattcagtttgaattggacgtattaatggctatcggggttatgagtctgagcagattgtgttgattgcaacaccatctgcctacgttatcttcttggaagcgttgtgccgtatggggggtgtggtgacgcacagggggttttctcctgaccccctccacatctcgctatcgtagattataagctcggcacctccatgttgaggaggtggtattttctgac

SEQ ID NO: 312 - DNA, 2440 bp, Unknown
  derived from dsRNAs of unknown virus
gaataatatttacttgatagatttgaactacagaattagtccactcccactatatcttcttcgatattaaatggctgaatttccgtcttggaatgcccctgacccacactccgatgagtccgactccgatgacggggttacgtttgaggaggggcaggcacatattgggaatgaaccccgactatctcctcactgtactggaagtcagtttcatgacggaactgcaatattcatactacacctccttttctcgaacgataagcgtgatgtaactcggcaggaaggtttcctagcacgtctaggtccaggttctaccgaatccgatctggacaacatacgcgatttgctcttccacatcatggatctaccccttggggcaactagaaccgagatctttgctcggtacgcgttgattgaggctatgccggctgctaggacagtcgatgacaggcgtttccaactctttgggctacgcgctgattggcttagcttagcatgtataaagacacccatgacacccgacatgatgctcaagtgtgtacaacatggcttcacgtctccactttcgttccatacttccttagacaatgctaggaaatccgggtgggatgcaactaggtacttccacttttgtgatggtacagctgaagcctatacgcttgagtctcgtgcccattctactcccacacccactattgtagagtttgagcataaggtggtcaccggagaggtggtacggagttaccttagcgttgatgatgtacctaccacttctttcattaatgcctatgggcaaaagtccgatgtatacactctgtctttcaccacagctgccacgaaccttagatttgtactccaagctactcggattaagttccgcactccatcaggcgatcctatgtatgccccatgcactgactttttcatacctgcaggtgtgctggctgaacagttaaacggcaacctcagaaaggtggctatcctactatttccaggctcccccgatctgctcagcatgatccgtgtccagaatacacgtgctgcggtatctattgtcagttccgtgattactagtcccgaggcctccgtatctgctagtccgttcgggtacatgacaccccatacacaacgatgtacaatcattgatgcatccaagtcagtcacttccgatacacaagtttcctatgccgatgtggtagcactcgccggcgtgacatttagtcagcattatgctacggaactagataagtctcttcatgactcgcagccattcgtggattcggtcatcagaaagatgtgtctagggtcgcacctggaggaggagatacttggtgagaccgcggcacagctcgtggagttcctcccacacttatctgagttgatggccaaacaggttgtaaagccccatatgattgagggtctcactgatttgttagtttccttcgttaccgacttccctggtgtcaacgaacaacctgactgttatccatcatacgacgctctacctactgaggtctatgaatacaatgatgctcaacatgctcagttgtacaatggaacaacatattatggcataccaaatcttggtaccggtgagcctttaatcggcgcgttaactgaccaacagcatgatattttacgggaccttcgtaatcggaatgcgcatataccaatagtagatggaattgcccttcctatcacagagagtccctacctccatattactgcactcggcaacctttcctatcacttggatcccacaagacagccagcaacccgacatcttaccgtattacatatcgatggtggtgtcggcttattttcccgtagtctaggtccaggttacgttagtggcatgtcatcttggcacacactgttcatcactgttcggggtactaatgaagctgctgacgttgtcaccgatgcccaactagctgtaggtgcactaaggcaaactgaccgctataaacatgacatgactgcgatctataacagactccagagtttgtataatgctgactacctaaatacggtcgatgaagtgattttctttggtcattcgttggggggttccttaatcagtgcctttaatctcactgctctcttcaccttccccaactccaacctattcacccgttctcaacctctacgggtgcgtcgagtctcattgaataaaggtgcagtaaatcccgacgtagcccataatgaactaagtatccgtacctacctagaccccatctctttagctgcggtcggggtttcgtacaacgtacctagtgcgagcttcctcagtcaccatgcaattgattgctttcgaaataccagacttagtctgtagtgcactcactctcctgttcatagttctttagtgtacgtaatatgtattcctaaactgctggtctatcgatcttcccatccttgaaagtattattaaaaactc

SEQ ID NO: 313 - DNA, 1593 bp, Unknown
  derived from dsRNAs of unknown virus
tgtaaaataactctattgagttcccttttattaacacatttgtgttagtaattacagccatgatgcatatgacttttagtctttacatcttggcacaagttgccatttaatcgtggcagttttacatacacctatgtctctagcgtttgcaaactagtaagacattttattatgcttaaactgagaggtaattttatgaaagttgaaagaaaagtctttgacttcaataaagccaactggcatcctgctaaatcagtaggagaaatccagtacccttggggtcaaaccctcatcgaggagtttgggctcaaacagtttgacatacttggtccgcgtagtatttacgacccggatgagttagtcaggcaaatcgagaaatactccggaaaatcggactttcatgtggacattaaggtatggaggcatacttgttcaatcgttagtaagatgttccgacacatcagagttgagaaacttccattccacgagaatcacgtgtggggagcaatcaaacctggcacttcctcaggactaccttttcttactaagaaaagagatagctttggaaagtgttttagtcgtgctaaacttatagccaacaaaaagctgaaacctgcagattgcgtcgcttacgctcgtactcaagggtttagagcagatggttccaacaagattcgtcttgtttggggttatcctctagaaatggttattctagagtctatgtttgctagaccgttactcgatgaaatgtgtaaatcacagaaacatttagcgtctggtatgcgcaggatgggcattgcctcatcaatgaatcgtttctaccatcacaacgtggtatttaactctgattggaaaagttttgatcaaactattcctacgcaggttattagtacatcctttcatattttgaaagaatgttttccagttgactcattctctgagagggatgagcagatctgggacctaataaggttgtacttttgtacatgcccaattattgcacctaacggtgaccgatattctcggcggcgtaaaggaattccttcgggtagtttctttaccagtttagttggtagtataagtaacattttgttacttacttatttgacactgttacaaggtgtaaacagtgatcttatggtcttaggtgacgatggcgttataggtacaggttaccctgtgaaaatatcaagacttaagctggacgctaaaaagtctttctctatgacactcgaaatctcaaaaccaatttatgataaagagttcaccttcttgaaacataattggtacggtgctcgcgcacaaagacctttggctgaaacagctcaaaggcttaaatatcctgaacgttataaggacgatctaaataggtcagacttaattgcttcactttacggtgataactttaagttatggagctatttccctaataatgtcaagcgtaacctccttcgatggagaggcgatgatctttcaggattgatcccgtgggacaaacgtgcgttgaaacgtgctactgggtatactattacactttagtacagcactatagggcgtgtaggccttgattcacctcgtattattctacactaa

SEQ ID NO: 314 - DNA, 1266 bp, Unknown
  derived from dsRNAs of unknown virus
gaatattaaaaccttataactcacagttattaccactatgagcgagaatgattcagagaaacctgaacctctctcttatccagctgatttgtatttggatggatttctgttgacaccaagtggaagttttccaataaatcgtgcatttatcacgtggcatgacccagcacacacagagctgcgccctcatctacctcgtgagctaggaacgttgaaagctgttctatacccaaaccaagtgatttcaagtatgattaatgctttggacccacgccaagacgaccgtaagtataagattgacggcccgtcatggtggaagtgggttggtgcagctcacgcttttgctcgagcaatggttgaggaaacagatggtcatgtgaacgcactacgtaaatggtatgaggatcttaaggaacggctactagctcagaagaagagtaagaagaaggtatacgagaggattaagcatgctggttctcttctagctacagctgagcactcctatcagtctctgtacgagacagttgcagtaatgatgaaagagatttactcactttgccgtttctataccggcacgtgtatcatcgcttcagctgttcggtgggacgagaccaagttgcagctacgcctaaagttcgcccacgatctttcacgagatgaggctttgactaggattcaggcgaagttcggggtcggtactgaagagatcatgacgagtccgcggtttgaaggtcttcgtgctacacaagtcttccagcgttccgtccttggacgtggtctagatgaacctgctcatcgccatccttttgtcaacctccctccaagccatacgatgccgagcatagataatgcggatcaatatttcgtacaagcttggaacaaggtagtcattcctaacatcgatgctattcgtcagatgttgacaccataccactgtttgccaagtggagagcttgtaccactgaagatggagacaaatccattaccacgtaagcgtaagctgggtgagagtgaagccccagattctgaactgattgacttcctcgaagacacttgcctttttgaatatggcgatgtccttgagtgaatgacgtcagtgggatttagttttgagagatgaatttagaagtaggagagacgtcaaatgcaggcctgtaacaagggcttgttggcgtgtcttctctcatagtgtgaaagttagacaggcttcccagcctatcacttgatttggcaagtgtcttgattaaagaggttttgatttacatc

SEQ ID NO: 315 - DNA, 1933 bp, Unknown
  derived from dsRNAs of unknown virus
aaatttgattcttttattttaattctcctcattaaaatttctcgtagttttcccatagggagttcatacgttttttataattttctttataaattacttccgttcctacagagtcaaatcgtttctttattacttgtttatgaaaatttacgccccgatttgggacaaaaatatctcttgcactaactctaaaggagctcttgatttgatacttgagctcggctatgatgtagggattgtcaaccagatccgcagcagtatactaggatttatgaaaggtagtaagattcgtcggtgtagtcctttgtataacccaaaacttaaacacaaaactgcgataaaagtaattgacttgtttgatgcacagtttaggaatgatatttctaaacttcatcctagcattgttgacctcgaggattctcagaaggtcaagttccactcttttagtcaacgtcttccttacgaaaagatgaataaaggttttctcaccacacttcgcaagaagaataaaattaaagggaaattttatcttgagaaagctttttggcaccttcataaaactaagttcaaacattaccttggtcgatgccgtccactttctctttctaataggtgtaagcgtcttcctaaagatagccaatggggacttccttttatgactaaaggtttcttttcttccgagaaacatcttgatatcgctaagaagtgctataaacagggttatttggattttatacctgccatttttggtatgcgtaatcagcctggcgcggacgatatccctaaacaacgtataattctaatggtaccacattttgtcgtgattcttgaaaccatcttctctggagtcctgactggtatttacaagacctacccttggttcgggaaacttaggtctcaaaatagttgtgactatcgtgttactcaaattcttgaacgtagtataagtgatcaatggagaagagttagtgttgatttcagtatgttcggctactctctggaaaagatttttctattttactacttttctcatatcaagcttatgtttggaatcaaaccaaatagccatctttctggtctaatcgatagtatatatgaatacttgagatccaggctaattgtactaccagacttgacttttcttttttgcgataaaggaattaatgatggttctggtcttacaagtagttgtggttgtttttcccatatgctagtttcccacgcgtgctttttctatctctatggccattttccgctaggagatgaatttttggatatttatataagcgatgacggtatctggtactggtatggtattctcgctgatgttatttccactagactaaaggaaatgtttggtctttccttgaatgttgaaaaatgtttcgtgcgtgttggacaagctattttttgtagttctctttatatatgtcactaccgcccggataaagactatccgactctatgtcgtccaattcgttctctttatcgtactcttgttggtaacgtcttcaaagagaaagggaattttgttagtagttctggtgagccgtggtctgatgtggatgagtccattcgatggattacacaacttgaaaacgtgaagtttcatcctctaagactaaagtatgtaaagtttattgctaatggtgattatcggttcgctcttgggatcaagaataaaattggtattcgtggaatttttcgtcttgtcgggggcttcaaagatttcatgggtagtaaaattagttctgactttaaatattcccagaccgtatattctaaccgtgtttcttctctttggatctttcgtgccgtggatcatctcattgaggaaaacgaaaatacctgattaagatctaagaaattaaaataactggttgctcttctgagtttcctcgttgaatggtttgttcaacgggcctaatgggtt

SEQ ID NO: 316 - DNA, 2424 bp, Unknown
  derived from dsRNAs of unknown virus
gggcgaagaggaatccaatggacctcctcttccaggatgagaacctaaccatcctgcctttgtcccctcgttacataacgtaaagcgaaggtatcttttcagttcggtatttctaccttaccttaaagaagacaggcacctgttagtgtactagcagcaagagcattgtcaaattagtaaaaagagtcaaagactcagattataaaaatgatacgtcataaaagcaaaaataataagggcctttggcgaacgtacccgtatatacgggacatttcctcaggattaaatattctcgctacactagctccacgtgagtgaagtagcgcgactactctatgcaaatcttataaatccctggttcggaaattaatcacgaaccacggacctgtcgaagccgcaaaacggctgaagaattatcaaaacttcgtcacccgacgggcactggagttaccagttgaaccactagagtggacccgggttgacaagacaggttggccaatcattttgaagccatttaagaactactgtacgtctcaagaccccatgaagaagcatttcgtaatctcagtatttcgatcgttagatctatttaaaggtcatactagtaaaaatatcgagaccatcgttgccccttttacagggtgtcagacggcactagatgaattcacaacttattgtaaaacatgagggaagaatttaaaagaacgacatgaacggtcaaaccgtccatgacgctttcgagaagaaaataatagcataaaggcgaaagccacgtcaggacccaatgggtcctccagcactttaagtctggttttagacgcggtaaagctatcagatagccatgaagtttgtgaaagcattctcatgctagctaaattgacatgttcttcagacctccagaaatggatgaagaagactatcgaggaagctggtcgcctatctaaattaagtagtcagtggaagccccataaggagctttctcttggtcgaattggttttgtacctgataaaggtctcaaaacccgcgttgtagctatcggtgacggattctccgcagccgcgttacaaccagtccatgactacttaataactatgttaaaggtgatgcccacaagtgctgcttttaagcaggacaaagcgtgagcaaccctcatttatcgtactctccacggattattctgtggaagttctgatgctacagcatttactgaccggtttccaatcggtccgcaagctgcagttcttgagagtgtaactgatgcgaagttggctatacactgattaagtgtaatccagcgacaatttaaggttccgggttcatgtgatgatacgattaaataccaagtcggtcagcccatgggctttctttcttcgtggccgttggccacgatcactcaccatgcactcgttgagtacgcagcggatcgggttcttacagaacgcgcttcgaaaagctttaaacgttcaggttattttattttaggcgacgacatcgtcatctttaatgaattagtgtacaacgaatacataattctatgtatcaagttgggacttgacctaaataaaaacaaaagcactgtctcaacacactgttgcgaatttgcaaaacagctgttttgacgaggtagtcgggtatcggcaattacgcctttatccctactcaaagtatcatatgatcctttgagtgtgttaagtcttttacaagaactttcacacctcggatatagctccatcccagcaattaatttgttggatttatttccaaagaaatattgaaaacaattaataccatttctctctaatccggagactttcaattacaattgtaatttgatcgactggagtgaagccccaaaggggttatcacctagccagtacggttgggtctggactcaaaaacagttctcagaagcgctttcctacgcctccttgcttttaattgagcgagaggttaaaaagttgcgttactctgataagagtaatcggaacttagtgaccaacaaattgtggtataatatccaaaagctacaattgtctgatcctaagatcgaaccagcgtacacccgtgcattctatgacacactgcaaaacttcggtaaagagttagctaaacttcggtttggtgaaactctgcattatgaatatgcgcagttcattaagcatgcccggtcattggacccgaacatacatattgggaaagataaacgtactgctgtgaacgaacttaacgttctaatccacgcaataaatcaactgcgaaacccagacaaaagtctagatgtttcaaagttcgataattttgaggtacaaatgtaccaaaatataatcgacgccattgcaggctctcggctatgggcttaaacccatagagtggagattgaagattccccgttaatcggggtagtctaaggatccaccacgtcc

SEQ ID NO: 317 - DNA, 2006 bp, Unknown
  derived from dsRNAs of unknown virus
gaataaaatttgtaaccaaacttcccagaacttttcttttctacgaaaacaatgtcctccgcccaagcagccctccagcaaacctcagcattgtgcgccaaattcgtgcacggatactccgatcccgctgccttcaatggtattgaatcctctccctttggtgaggccgagataagtcatgaagccggtcgcgctacccttactattccatctggtagcgatggtctcgtcgtcgtaatggacacactccctggtgttaacggtctatctgccgatgtatacaccatgaacggagatacttgcactgccgtatcctctgtctctcttggtcgttcttccgctaccaactatagtgccctcggtctttgctcattctccgctactcttaagagtaccgcttctgataccaatgctcaaggtgttatatttggcggaccagtgcgcggtgcccccattaaccctgagacattgtcccagaccgatatcgcgtcacgtatctctgatcccaatgatatggctgatgcaaccagtaacgactgcctctctgtcctagctatctcacccgatcttggtgaagatatggttaatcaaggaggcgcagaatcttcgaccggtaagaaggaatcatactcaggttcatctgtggatgccggggcagagttccccaccatgtctgctagtgcacttgttgcttttgactctagcctcattcctgctggtcgtaccgatttccaaaagcgcaaccctcttaccacgaaaagtagttttatcactgtgtccggctccctttcccttgatgccacagctgattcttcagccgatagagacattatcgtcacctgttcgaccgttgatgcagctggaaccgttatcagtacccaagccgcttctttcaccgttgaaataaatgctactagtttcaacctgcctatctcatttgctatggtgaatactggccgaccggctaagaacgtcaaagtcactgtgactacattagctggtctactccgatctcacgcttccatccagattgagtctaaggcagccggcctgacatctaagaatgctggacgacccgtcgttatcctcaaggtagttggtggagaaggctcgtactacctaaagtacgatgccctgatttcctatatcctagctgaggacatcaaaggtctgtacagatccaacacggcgtcatatcataaaggtactgttcgtacgttcctggagaatactttcgtcgatttcggtcagatccttcctgccggctacgccgaacaggtaaaagccatgtcctatgatgttgctcccgttgtacgtagcgctatgtccactgataaggttggcgtggctgcctttcatttcgggcatttcatgaaggatttcggtaaaggcctcggcatggtggctaagggtgttggctctggtgcccacttcattagtaagcataaaaaggctctcaagaccggtctccaacttgccatgttggcacaacctgagttcgctccagagttagctgcaggcatggccgccctcgacgccggctcttcggtcgggctcatatgaatccctgtctactttccaaccgtgttattagccactgacggcacctatgaaacacacaaagtctatactttacttcttagcaaccgaccttatggcaacaatcagtatgttaatactaagggtgtcttcctagataccgagcttttagacgtctcctccgaccttttatccatattattgcgatgtgggatcacttacgttagtgtaactgaacccctttccatacatggacggtcatgggagatggtcgccgctctcggtgccatacgtcgacagccctgctttgctaccggtgtagtaactcgttgggatggtagaaccgttttctttggcccagtccagggcatagataagaagcagaaaacctataaaggattacatttggaaaccgtcttcactctaaactccttggcagtgtaggcttttacatatttataaaactc

SEQ ID NO: 318 - DNA, 2006 bp, Unknown
  derived from dsRNAs of unknown virus
gtaaagaaacttttcttttccccgacgacatacgggacctctgaaccttccaagttcagaaacaagtgtcagtattaacctaataatatttaactaatgtatccattacattcaggttacagacgtaaccgaacgattttatcgttagtacctcaaataggaggtaaacgcaatcccagctccttacaaccaggaactggagcaccactgagtcaaccgggcgttgcacccagaccagtaggttcacccaagcaatttgttgaagtatccactaccggacaagctaagacagttgcagaatcacaaccgatgacagctacttcgctggaatcaaaccgcaaaattaacaaaactaaacgcatgccatctacaaaacgtggaaagaagaaagaggaaaaagacttcatgtatgtccctcgaggtggaagacctaagccaccggagaaacccggtttacagtatacaactaaggatcgtgcccctagtggtgacgtccctttcagagacgggcccccaactttcacgcaatcttttccattaggaaagattggcgaattaccgaataagaaacagactacagtaggatgggacctttcggctcaaaaattgaataacatccgttgttcaatccaagttatcgcagctgccttctttggccaagtgccaacattctcaacaggccctggtaaactagataataattgtgacgatacacaaggccgtattttcggtaccttttataatcagattagagctatttatcaagatagatacaatcttaacacacaatttgtaaacacattcacagcccaaaatgtattcacgtacttccatgatgtacacgcacttcatgttgaatttgtctgctatttacaacgagcagcatattacaaaaacgctgatacagggatggagaatttactcctagataacatcggtatcgttcttaacacagatgcttttacaagcattcgaaacgatatgtcacgtgcgttacgcttttctttcttaccacagaaagtaattgactctaactacgagatattccagacatacagaatgggagaccaagttactgcgccgtcttttgcatatgtaacaccagcgatgactaatttcatgcacgtcgctagtgcagcaacagaccaagccgcatttgatgcagctgtaacaacatacaaaacccatgtcaatgggttaattaataacgttgttaccggacgagctaatgcaacccctgctgatccaggtattctaagaatgtctagatacaccaacgcagctggttcaactactaccaattactatcctatgtttgacataggtaaaggtgctttaagtcaaaatgatatcggtttcttaaacagtgtgtttgcacgagtggcagcctctacaggtttatctccactgaataatcagaaagaaggtaattcacaatctcaccatgacgtagacatgtgtgacgcgtttaataatcatttactatctactagtacaactgctgtgttccccagtgtagtttctggagtatcacaacatgtatcacccaacggattcaattctgtagtttacgcttcagagagaaagtcagaagacgttcttttcaaagcaactcaattccaagctgagaaattcacaggttcaggtcatttgctgtatcgtacagattcagccggtttgggtcgttggactcgctactatttagatgagatagatcgtaatactaacctagagcaatcgtcagacctgacattctcggttaagaactcttgggcccaagtcggaaacgatacgcagcccttcgttcaagacaattacgtaacaaaagtcttcagaaatgaagcgaatacagcttacctttcggtaaacaatgtagactcaacgtctgcggcaaagtggttcatcactatgagtgaccttatggagaaacaatacgactatggtattgatctattaatgtaatgtcattggttaattttctagacttagtctagaaggttaacccc

SEQ ID NO: 319 - DNA, 1434 bp, Unknown
  derived from dsRNAs of unknown virus
gaataaaagaatcgttcgaaagacacagataaactatgaatagccgcactaaccatagcaaaattcagggtggatccagtaactccacccgtacaagaggaaactctcgactaaaggtggtagggacccctaaccgttcctctcctcaaaacaatatgaccccgcccaccggccgggtctacaacctatcgactatgtccatcaatcatcgtaccgtggtggaacttgaggataatcgtacgaattcagttacgtactatgcccccgtcggaactccctgggaagttcgtctgcgtgatggggatgctattattgctgatcgcctccgtaccggtccgccaatctctgtggaacccggagcccattcaccccatatcaccgccaagatcaggcttactttccacgcaccagcccccacgggtggtgatatgatctaccatcttatcactcatacccacgagaaccaacacttgttaatgcagctcagtcctactgtcgacgctgctaagtatcttgccgctatcggacagccgtctgtacctccctcacccttactggtagctggtagccaccttttaccggtggctgtggtatcgtcacctgttgcggttgctacttcacccacactctccgtatcagacactcagtgtgtaccaccagtttctgatccgaccgtggctgtacccgcatctaccccggttactagagcagagtccccatcccctgggagtacatcaaatgctttggtaacaatatcccttggggacgacagtgctcgcgttacccgtgccctagctgcagagcttcgtgctacttcacgatccccagacataccaacgacccctgtggaacccaatctcgatgatgactactatgcgtctttaacgccggctgactgccctctcatagccgtcgcccccgcgttggatgtgtcgcctcaccccatcaccgatgagccggtagaagtctttgtgcatcgggatacccttagtaggttagtgaatcagtacttctcaggtgctgcattctcggtatctgctctggttaacctgcccacgcgcgggctgcagttgggcgcaacccccgcctctccgcaaggttccgggattaaggtcactgtctacctatgccaagatcccactgataccaaggcctggaatttcatccccgcgatacaacagaatggtcgtagccgtcgcccccctcagtgtaaaggacagcgaaacccttttgctgttactgggcgtcgatacatcacggtcacgcagtccactcgtggattgcatattgaccatcccattttggatgtggttatggactgtttaaacatgtatttccaggatgaaggatctgtcattattggttaaccaccaggcccctgccccctctactctttctttcttctgtcaactagaacttttcttttattaactc

SEQ ID NO: 320 - DNA, 2120 bp, Unknown
  derived from dsRNAs of unknown virus
gaatataatacttactattgaaaactattactataaacttacataaaaattccaatgagttacgtacaggcaacaaaggcttacgcggttgatgtcgctgaggcatctaccaatgctttcaacaagcaggcccgcggcgatattgaagcccccggagcgaacgagaatgtgcgtctattcactgccaaaggtggttctgcagttacgctcagcagtgccaccacatccgcctcaattgtctttgacccagaagcgagccttaggaacggacagcttcatgtcaacgttttcgaacgcaacgctgcaggatcgtgtgttgctgtgcagactaccagccttggtaggccgtcctcggagttcctctcttgtggtgttttgagctctggacttaaggtttttaactcctccggcgttgatgtcattggtggcactcaaagctccgctgtgttgacttctatccctaaagatctgtcaacgatcacttcgactgacttgtctaactcatgtgctaaccatgaacgcgacctgatctcaggtgtagtgtcgcgtgaagattcaacgatgactactacattctccaatcactttggacagaaaatggcgttatgcaggactgataccgaggcgaacgtcgtcaagcggatttgggacgaagcccgtggtagcaggaggtcaaccgtaggtgaaagcctctctttcactattcccacagatatgaacgtgccagattccggcactcttactaccgtacagattgctgctgaacttgctgcaagccctacttacattggtggttccacgcccgcgactggtgggagggttttccttgatacggctcgtcttacggctgctaacaaccctttgactctcgcaacttatacggtggatgttaacgcttatcttcaattccagaatgccagcggtgatgtccctgcctacttccttagcgcgagggtgtatgctatggacgcagccggtacgattgttgacacctcaaacgttgatgatagagttaacgttgattcgcaagctttcgacgcctctttcagatgcacgttgaagtcatcttccacgcccatcgcacgtgtcgcggcagtggcagtctacaacaactccaatatgacgactgacctggtttccaacggtcagactcatatggttgttacggcttatgaggaaactgctgacgtgcctgcccgtccgattcacgttacggtcctggagggactgaacctcggcgcgactctaaacctgtccagttttgctgtgctaactggtgtgccagacgcaactaacgtcttcatttctcctagtaccactagtacggaatccgtgtatgatgataacgcagtcgaaatgttcctaaaatcagtgagccgaagcatgcctagggcattcacgatcgctggacaggagagtactggcaggcaactgcaagccctctacggtgatgagaagttagaagttgccttcaaagcgatgtctttctctgaagtaggctctgagctcaagcgcattggcaagtacgccaagcgtggaacaaaggagctaatgcatgtaatgcgagagctagaaccgctcatggaccgtggctctgcaatggcaggactgcccggacccgcaggtgtcattggtagtggcatggcggtaggtgctgaactctcgcgaatgtcgaggcgttgaaagattggccattttccaagtgtcattgtggtaaatgatgttatacgacctggtctactacatcacgttctacttggagagaaagtaccaaataaacgatatagaattgagggtggaatacagattgatataaatttgaaagacgtcggtgctacacttcttaatctcattcgtcattataatgtaaagtatgtaacgctctttagagatgtacacatggaaggaagatcttgggaaatggctgctatggaagcattacttgggaatactggtgtgtattccggaacggttgacgccgttgagaacggtaaagtgttttatggaccggtaccgggattattgcagaaacgaaaaatatataattttatacaaaatagtgaatccaaatcatatagctcactttcccggtgaactacatgttaagtatttgaaacatc

SEQ ID NO: 321 - DNA, 1869 bp, Unknown
  derived from dsRNAs of unknown virus
gataaattaaacaaaatattttaagtatattagtttagcagccaagcttcattttatcacgggctcgttccgtccttatctttggctttatggagaaggagaaacacttgagagtaaccaatatgaaacctctaaaattttttggtgctgtggatttaaatattaagcactgctattcgaaaagattgggatttctaaatggatcgcctcccttcttagaagggatcgaaccgcagaactttagaaatcttgagcgacacattcttggcctgagatccggctccaccggtgatcttgaatcaatgctcttgcagggtctgcttccttccgagaagcagcaaaaagcgcttcaaattgtccagattgacaggttagcgaatgaatatccatggattgaggaactggagaggtctgaggttcaaaagatcgcgccgttttcaaagatcgccccttggtctgaggtcaggtcggtatatcatgacagtttctttgaagcgcatcctaatgacattgatcgcaaatcagctttaatagctattgcgaatgtcaagaagactttagctcctggttgtctacgtgttcggtctacgacgaaagttttagaagcaaccgctacaaacacgcaatggggactaccttactatgtgtcaaagccagatgaggcacagatacagagttatgttagcatagctgaaacagaccgattagcaggaaaagtcacaaggtttccagccgttgccggcaaccgtatgcagatcacgcccgaaaaagaggtgaataaacagagattagtttggattatgcctcacagcgtagttttaaatgagttgacgtttgcactgccattaatggaagcgttgagagccaaggagccatcctttgccagttttgctggaactgatagtacggacgcggccattagtagaattttcgattttgctagacttaattcgtccatgttaatctgcatggactttcctgcttttgattccactcttggaatcgatatcatcgagattacttttgatatcattaaacattggttccctgattcagaggcggcattgttagacgatttgtgtgacaatctgctgacaattcctttactcacaccggaaggggtctggttggacaagaaaggtggtatgccttcaggatccggttttacgaccgtggctaacaccatttcccacatgtggattcgtgagtatgtaaaagttcgaagtggtctagctaaggtcaagtcgcaaagtgtaaactgtggagatgatggtgtgtggtgcatcccagggcttgagaaattgagtattgagaacgcatttaccgagctcggatttgaattccgtgagaacaagttcttgttctcttttgacagggcaacttacctgcaacggcattaccgagacgattatcgcacgggtggcattacccggggcgtgagaattttcaccagagctttcgccacgatgtgttatttggaaaggtcgccgaaccccaaaatctggagtaagtactttgaatctgtacgctggattgcccagcttgaaaatctcaaatatcatccctattacagacacttggtcgatgaaattaggaaaatcgacagactacaacttgggattagtgtgcccggaggcgtagtcaatctcttctctttagttggtacagaaaaggaaataaacgccaaacttagcacttatatgtggttagactcacaggctataaaaggtaagaaatatccttccctagagacagtgaagataatcgaggaattggcctcaaatgagtattcgaccagcaataagtagatagaactctagctcaggttctaatatctagttgtaggagggttgcaagtcgagcaaccgc

SEQ ID NO: 322 - DNA, 906 bp, Unknown
  derived from dsRNAs of unknown virus
gaatatttttttagtttattgatgatgaatgctagtggtaaaaggacgactcaacatgttttcgaagaggaggctggagacaaacgcggagcaagtgttctcacttcctccgtcgagcgctcagagcaagctgaagaggttgaacagtctgacatgtctggtactccgtttggggctatcatttgtgcgagaagcgctgactgggctgattggttccgtgaatcagtcgacttgcagttttcacctattgaatctgggcttattccgattaatggggttgcctcttgtcttggcattggtgtagttggacgaaaccaaacagtccactctaagacttggtcgagttctatcaagctgggatgtgtggcacgaaatgcatgcgtatacgtcgctacttgcagtgcccttcaccttctcatggttcataaagtagtagttatctacgatatgggtcgtgatggttgggtgatcaagactggaggtatggagctgatcgactcagttcgagcacacatggctgaagccccaagtgatatgtggtcccacaggattcttgctcttgagaacaggattgcacgtgagcttaaagctcccggtcttaaccgcgctacctggactccaaagaggcgcaagtttgaagcttttaagcagatcttaactgtaggacactcaattggtcttccaattccttcgaagttcgagcaactcggattgatcgcaacgtctctacttcaagcaatgacgggtcatccacgccgtagttaaattccctatcgcaatacggggatacatcaatactagttctttttcatgtatgcgttcgcaaggcaaatgtgtgtgaaggttaacaagatatgcgagcaaccgtaggatattttgactgggttatctaaaaagatttacatc

SEQ ID NO: 323 - DNA, 2356 bp, Unknown
  derived from dsRNAs of unknown virus
gaataattttttggttatactaaaactttgttttaaaatcgtttaaaatgatgctcagtgctaacgcttcacttcgcagccgcgcgcttcagcgtactcaacagtatcaagatccaagcactcttctttctaccatggaatatacagatttgattggtaagttgatgattgatcctttttctggagtaagtgcgggcgttgatgctccaacagatagtaacgagggtgcgacacttttccgtcctattgctttcaatactctacgcgttgaagatgctggtgtgacgaatgctttggtgatttttgcagctgaggatacacttcgcaatggtggacgtatgggtgtgcgtgttattcttcgggattcttcgaacgcagtggtcaaggagatttgggttccactcactacggcttcaaatgacttgattgccgctggtgtactatcttctggtctgaaaattgggaatacatccggatacgataagagttcaggcgctcaaatggcagctgtactcttgagcgttccagagaagctatcaactatgacggcaactgacattctcacgtttgctacacgcaagaggaacagtacgctgggcatgtctgatcggtcatctgcgactgtcacggtgagtcctactcgtcatctgggagcaaatatgagtctgcttcgtccaggggctctctcaaacattgtgtccttcgctgaacatatcgagaagcatgactttattccacttgctgacagtgtgggaactcgcaaccaaaccactccagcgatcatgctcgctgcagcggcttcccatttcttcgattcagatgttcatggtagtcctcttaattttgcgacttacactgcgaagattaacggaaccatcatggtgtatgagggtgcggggtacaatgccattcagaatggtgtctattctaagcattatgttttggctcttgattctgcaggaaatatcattgattcacatgagctttctgcacctattacgcgcaatgctttttcgaactcaagcgcagcatacgagatagttaacttcaatgtgaatgttactcttcagagctcgactgttcctatcagtcgagtagtaattggtgaggaaagttatattcggcttaatgatggagctctgggtgaaggagatgcatcggctgatgttagcggcttcttctccccaggtggatttgctcttgatttcgaggctatcgaacgcactgctgatatccccgctcgtcctatccacattgctcttgttgagggattgacgactggagccacaatcacattgcaagcttcagccattgtaactggtcttgttgattcatcgcgttctttcctagccggtagtgaagatgatgatgatgaggaagatccatctcgcatcatagatcatgctcttgctctcgtctatttcaaggccattgaaaagaatcttgttcgtgctggatcttctgatggatttggtgtcatgaaggcggctatggcggaggttatctctagtacgccccctgaggctattttgagtgcctcgtcgtattcaatgctatcttctggagttcgtaaagcatcaaaggctatgcagactgctgtaaagcccaagaacctcgttcgtgctggaaaacttgctctgaccgtagctgacacgaccgctaacctcgccgctgctggtcttctatgactaggcacttctttctttcccacagtcacttctgagggaagagatcgctatcctggacctcttttaactataaatgtctatattagtgaatttcctattgaaataaaatcagactggtggaggaacaagtcgctctatttagacatactaatggataaactagatcaagagaacgatagcgggacagctggtcatatctatgctgaaataaaggatagtcgtggtgtactgattgaggagttggacggtaattcttgggagatggctttcatcatggctctgggtcaaggtgggaagggctatgcggacaaaactctattgaaggacgcattctacaaacccaaggcttctcatcgtgaacaccctcgagctaaactcactagtctagagaacatatgtttttctggacaggttggtatctacactaagggacctggaaaaagttttaatgtctatttcgatccggtacctgagttggaagagaaggctgagggcgcgaggcgaatggattgtaagtttataactgctgtatcacatgatcataagtatcatgccatgcatatgtttaatctgagctggccttattaaaaacgtaacaaaacataactaggtatcgaatggttgttcaccacaactgtttgcttgcttttgaaccaaaaaattacatc

SEQ ID NO: 324 - DNA, 2851 bp, Unknown
  derived from dsRNAs of unknown virus
atttacaaagagagaaaagacatgattccaaagacaggagtggatctccgggcgggaatcggcttcggccagctctttgttgcgtgggtgtgtgtctcgcccactgcagtttagatattggtcgttgacccctccctcagccgtggataagaccggagctttgggaggtattggccggtcccacttttactttggagattactccgccatggccctcctcttcggggggccttgaaaatggtccttcacgagatgtcggatcgagatggggcggagtcagtcacttctggtggcagtgggcgcggcgaattttcttacgacaatatcgaaaaggcgcgcttttccatgcgcacgggtaaagatgtggatatcggacatcgagccgaggactccaacatgcggttcttgcacataggcatgacgacatgcaattggcattctcgtctcgacgccaatcacctgcctgtgctgcgcgccaacgccgagggcgtactaacgttgttctgggaggcccctgggtcttacggaacgatggtgaacaacatcaatggtgcagacatcgatctgccagattgcattggtgtaggcgcagctacaaacgtcctcaacagggacgttcctgtcgtgtccatcgccaattggatcggttacaaccgccagagcttcaagctgtactttgacttcgcgttcttcgcggagcacatgagcatcgacttctcccgcaagcgttcaaaacacgttgctggtgtgctcgggcttgtccctgaggcagaatattcctggttgcgcagcgcagccggtgtccctgaacgcaaagactcgatgatcacgctctatgttaggggtttcaccgcgcttgcgaccgcgcagttctgtgagtcgtatttgggcgcaccagtatggaagggcggagctgcgacggttataaccgttcacgacatccgtcagcctcttgcccttccggcgatgaaggctgcgattcaggcgtgccaagccggcaccgcgatatctctcgtgggcgatctgctcgatatggaagcagtgcgcgctcttgaggctatttgccatgctggcgcaggagtggatggatcagttgtcattaacggagtgaactacactcccttctcgcagatgtacgacttcgattgcatccctaacatccacatcttcagttctaacttctacactgccaacatagtcggagcgcctggaggtctggcttacgtgcttccagctgccgcggccccgccatcagcggcggcgctgtccgttggtctcaataagatcgcaagcgctcgcctcgaggagtttcacttctcagcggctattacattggcagcacaactcgtgactgggatggtctttacggataagcgtgcgggtcaggctggtactcacaacttcatgccttcgatcatcgctttcgatcgtctcaccattcctaggcccgtggacgattctcctctgttcgcgctcttcgcatcggaaacgtacactcagacgttcagtttcgaagacttcgtctacgtggcgtccatgggttacgagaccctcgtcgcgcttatgtacacgctcggtcacaagtacgcgtacgctcactctgtgtccatgaagttcaacaacctctcagggggccatttcgcggcactagctcccgccaatgggtggtggcggcaattgttcgctgccactcgccgctccattatgccgtgtcaattcgatgagatcgcggccgtcgccatggtcaagacttttggcgtgcccatcggggtgggcgatttcggccggaccttctcgggtactgttggcatgactgccaatggccctaggggtgtcaacagcttcgtcgtaggtgacaaccttctgatgattgtagcatccaccgaggttctcggaactgcgtacatgttgccatgggtggcttgcgtgccactagccggcgacagggtgccattcgtgcctatccgcacatccctggctggtcagactcgtcgttatagcatttctgcgtataggaacttagtccctaacgaaatgagcatggatgagggcgaggcagtcgcgcgtatgtattttgttacggaacttgccactccagcgactcaggtgactattatcaccaagactctggtggccgacccctcgcaagtcgagtggaatcaggccgctccgccggtcgttgttgcgccggtgggcggcggtgtgcccgtcattcagagaatgccgaacgagcgttccttgattgttcgagacgccaacggcggttttgtatattctaggatcgacatcaccgccaatacgtcgtccgcctaccaggaactgatgagcgtaaagggcatgcctcgtcatgcttctatcgtgtggcctcaggcatcgccaatcgatcccactgattatggaccgatcgtcatgggcgggagcagttttcttcctacagggtcgaccgcagtcactcagactagcgtgctcgactcggccattgctgagacaagcaaggtggtggacaatacgcgcatggcttactggacgtcgcagattatgatgatcgagcagcaacgtgctgctgtggcagcaaagctggagcaagcacgcaaaaaacttggtgtgagtgggagcactgacgaagataagatgaggtaccaaggcaaagagaggaagcaggtcattgaagaggcgacaccacaattggttgcaccaccgccatcggatgtggcggccatggctcacaaaggcaaagacacgagtgctggtgctgatgctgatgattaattcagccgaatagtgtgaatcgccttcctcttgcgaaggcgatttgctggcatcggctataccatgctagctaagagcactt

SEQ ID NO: 325 - DNA, 1866 bp, Unknown
  derived from dsRNAs of unknown virus
gaataatttttgcagtagcagtaagaacactaaaaagggttttgtttgttactaagaacgttccagcgatggataagtttgagacggaatatggggctttatatccttctgaggatggagctgtatcaatattgttctactatcagccagaaagcgtaactgagtttcatggtcgtttagagttctttcttaggacaggcgggccagcaatggatatgagtgggttgactgaaatagatctagttgagagagctatcagtgagacgaaatcttttgcctatcaacattacgatgatgacgccgagaaggtcattggtatgctaaactctgaaatggaccgattcagggaaatgtattcagtccaagattatattggatttgaaactataatccctttcggtaatcctgagtttagaatgatagtgtcagaacgactagcaggttctggaccagctgatgaacctggtgacgggtctgaagatactgaccctgtctctgaagatgttacaagtgtcgagggggctccgctaccagatggggatggagctgcggaacacgatgaggatgaggaatccgaggtttatgaaaccatgtcagaagaagaaggggacaaagctacgttttttgttctggcagatttagatgcagtgcctgtacctgaaatcgccactacaaccccggaggtgaccacgccaccgtcttctccactttcagctatctcgcctaaactctctgatatgctgactggtttcagcagcccttctctatctgtgatacagagaatgatttcaggtgagctcttggatctttcgacacgcgtcaaggtcttttctggactcatgaaacgttttccactgaatgaacggcctgagtatcccgatgacattaccggtgatgataccttagcggcgtcaaggattatagacattcgtgggaggatcgcaatgcataacaaggacgttgaggacatcctagaagggagaaagacttttgatctaaaacgtctaggcgacctatcactattgattaagaaggcgaaagctgatctggtcgaaacgaagaaggccgcgattaagaaaagaaaacctggtgctctttatgcacttctggccgcttctgggggtagcgttgaagaagagggaacagtcagtcaagaagattaccaatattttctagatgaattcgtttctccatatgcggcacgtgaacctcttatagtgatggaagatcagaaggagcctacggctgaggccttatatatgaacgccttagcggcaggtcagtcagccttcagagctgacctcaggtctgccgttggtccagttgggtttgaaagggatattctaccagatgttgttatcccgaaagacgtgggggagaggctggtacgacaagccttgagctcattgacacattacactgctgatagcgctctaagttatcagattaaattctttaataagtgcattactgcttgtgttgatccaatgatatggactgcaatgactggcggcgtagttggtacatacgttagccgtcttgttgatcgttggattgataaaggatataagagccttctaatccatgactttgatgacatttataggcaatcatcacctacagattttcctcacatcttgctctcagatgtgcaacccatgattatggactattccagacctatgaagggtagcacgacagctgcaactgatgagagcaagaagaagaaacctgcaagtgagggttactttgaaaaagagtcagggaaggggaaagggggcaagggagtgaaggtatccaagcctttcaagaaaaagtagcttgtgaaccaaatttccgacaaccgaaatgcaaaaattatacatc

SEQ ID NO: 326 - DNA, 1191 bp, Unknown
  derived from dsRNAs of unknown virus
gaagaacactgcatactatgaatgaggttactgaatttttgtcaaacagtgagaggcaagttgccaatgagcatccagggcgtgtgctgataaagtacgaatatagcggtgctcttccaaccggtggctcatccgctcttgtacttcgtcagactggtcatggtgggtgtggtttgggcgccgttgttacctacgggaactcgggtgacgtgctcacgactacacgcatcattgacgatgttggtgatggttctgagattggaaatggtatgaacgatggtgacattgagttatattccacattggaggtgagctcaaatgtcatggggagtgagtcagttggtttcgcaacaggtggcttaatctatccacgtgcatacggtgtcattagtaactcaaccattgaatcaagccaggctgtcaatacgtctgtgagcagtaccactttactgaacacgggattgaaggttgtggacacgtcgattaacacgacatgtacaaacatggcccacacggcaaaattggctatagtgcgtaacgactattcgttcacgactacgcctgttaccgtgaatgacattttccagagaatgagtttccatccgacgacacgtggtcgtgtgactgtaaccctgcgcgacatcggcttcctaaagaatgtgggtatgaatgagttaaatcccaaactatcctttatctttctggcaggctcggttccacagagagtgcaacgtagcacggtgatgaatccaggatccgtgtatgagcagaatctgttttccgaagcggttgttgaggaagatctcgcggcaagttacactttcactatgaacttccacactgccatggctgtagacacactttggatcgcgttggattcgaacactcctggggccacccaagcgagcgcgtttagcggggacgtacatacgaccgttgattcgacctcccttgtgagcgatggcttcccttatcaggcgctcgcgatatccggcgtaagcgatactggcaatctgaggtatgtgctccagcggtacgttctgaaaaatgtccagggtgggtcacactctgcacacagctctaacggtagattcagcctatcaaaactgcgcgacatgtctgttcaagatatctcattcaaagtctagaagcccataccaacgggatctacacttctaaggtgttaaactc

SEQ ID NO: 327 - DNA, 2385 bp, Unknown
  derived from dsRNAs of unknown virus
gaataataaacaaccaaactgtatctgtagtaaggaataccacaataagaccacaaacccctctatcaaaagcagttacttcagattcgtgatatttttgttcatcaacttccatgacatccagcgtaacccaagtcatcaccgaggctcccccctcggaggaggatcaattgcaggtcctcgatgcgatacttaacgatcagtcatcatgtgttagctttgccgagctactacttgtccggattagggagcatagtccaactttacggctccgtctgaacaatggattacagcaccttacctcaagcgctattactatcgctgacgtaggtactcgtaacatcaaattggccgactcccatggtccattagattgtaaagtcggcatcccccgtaccgctgcggctaaacgcgtcctatgggataatactcacgcgattctaactaggaatcggatggcgggattacagcttcgaaatgtacggccccttggttccggggtcgattccctagccattgacagtgcggcggttagtcacgcgggttcccagtctatccttcctattcaggcagactctactggagctcctctttcctttagcagcgttagaaagagtcgatcacataagcctcgtgaggttgaagttcttctgacccacaagcgtggcgcagttaaagttccaacttcttcactgcgtgtcgagcaatctcctaacggattcgtccaccctgaagctgttatccccgcgttcgcggataggctccgtcaagttccaattagattaacccaaatcgtactcaaggatcatacccgtatgcgtctggcagatctcaagattgatgaagccgtctatatcgctgctctcaagcagccccatactctaacagttgaatatgaggcagcactcagtgagcctctagcagctggtgctacgttacatcacactatggttggtttcgttgaaaccgcaatccctgatcgcgatggtcacccaatcaactgtaaggttgtactatccgtagtagttaaggaccaattcagccacagcgccgtcattcatggtatatctggccaagcctttggcattagtatcatgtctataggggttgatgcccttgcggcctccgtcaacccccgtttcttacacgaaacggcatatgacggtggtgctatggcagacgcagctattatacaatcgtatggtggccctggtagatgtatgttccacgtacgcggccaaggtcatgcagacatgtttaaattggctcatagactagcccaagtcaacaaatggactggtatgccccgccgccacggtcagggtactagacctgatttcattcccccttccacctacggacttgatgttgaagatatcctcgcccttgcggagttaaaagattcccccgtgccagtaatccttgacattgttcgttcgttactggctaacttgggtacctctctagcttctttcaagctagctttctctaattcgctgcatgttggacgtcatgacaaaatctgggtaagcgaagactgtgaccaacttgctttgttacagcaatttggagttacggccgtatctagtgacgttatgttgctaaagtctctactctcgtctatatgtgatattactatggacgttggttctagcgctcacatgccttatgtgactgtttcgaatcaacatctctataccctgttctaccccctcagccatggtaatgtagttctggaccaaacacgcctcgttcccgaggtactgttggtccctgccacatccttaattgtaacctccgtgtataatacggtggatacaaatgggttctcatgcatacaacgcctccagaacaactttcgagaccctctgcaaggtccgcttcgtggtaccataccccttggagcgcaggtatccctccttaagttggataccgcggaattaagatcttccaccgtctctgtatgtatccatggcacttggtggtctctcgataacctcatatctgttgctatcaggaagatagatagtgcatttgctgctcccaagaaacctgcacactctgcatacacatttgtcactccatatttcgttttgctcttcgcccttggagataactatgccgccgatcatcgcatccgcgtctatctccatgacactgggcgtcgttcgctactgattaaggggttcaagaatctccgtaatcatatgttatcgcagggtaagtcagcgcaactgttaaatttcatctttcactccactggcgtggcccgcgagtacttgcagccacccaaacggtgatctcgctcaccaacgttcaatctccctctacttataaatggtacttttccgctcgatgtcaaactggtcgttttattaaaaactc

SEQ ID NO: 328 - DNA, 1345 bp, Unknown
  derived from dsRNAs of unknown virus
gaagaattctgtgttatagtgttaccaggaagggatgagtataagccaggctattgcgggagctgagaaggaaaagcgggatggtgctaagaagggtccaaaaatatctacgggttcggcgagtaagtcgtcgaatgaagatgaggacttaagcagtgtcaaaatgtatgccgaacttcgtagcgcgccaatgagccagccaggtggcgtaatccccatgagcggcatcaaattctcagcgcatgagcaggagcgtttgagcgaggatgtctttgatgattatcaaggtatgaaggatttgctgttgaacggtggtgctttcaagcatgatatggtcgagtctctctctaaactaatgaagcggctcctcttgtgtgggagctatacatccccgatgttcattgatgtttcgagtttactactgacgctgttcgacaccctgaagagtgtcatcgtgaatgggatgtataaatctgacgtcgagggtatagaaaagcgtgccagcatgctcattcagttcttcacacttgtaacccctgggaagaagtttgatcatgcgttcgaggttatggactatgcagtactctcctctctagttgaaagtctgatcgttgtgtttaaggaagtttatgaaggtgtcgcacggtcgtacaaattcctagcgtacgacgtctcgtgtccgtatgacgcgcagacgatgtatggcgggcctgctgtgttaattggtattatcaaccaactctacgagcacgccatgctgcagcgaggaccaacgaccagtagcgtcacatctatttcatatatggatggcaccaaaatgattaccctccaaccttcgcaagtcttcgttactcgaactgatggcattactgtatgcataaacgagtgtactccggggaacttaaaacctaaggacctgttctacattgaggcgggtgcacttaaaaatgtgtatccacgtctagaatcggagaaggtttccggtgaggtgagaattgcgaggaaagcgacttatgtcccctatacttcgtctcagtcacgcatgattcctggcgaattcgcatccaatcttgggttcctaacactaacagactcagtcagccctgacatgctctacgagagtaggtatgtgcggttggcaagcattgttgcaagtctgtgcgcacttggcgtgcatcccagaaatttcgtgcgaagctatcttggagagcacagcggaccattcgaaaagttagtggatttatgggagcatgaaatcatggaaagccgcagtgacggcggtatcactgcggatgctatcatggcgtctttccatgattccaaggcataattcagaataaaactc

SEQ ID NO: 329 - DNA, 2811 bp, Unknown
  derived from dsRNAs of unknown virus
gaataattttctcaaagacaaagacgttaatggaaagcaccacaacgtccctggtcgtggaaagcctagatgagggcgagattttggaatcggaggatgacgcaattgtagtggtaatgcatgcgcttctccatgatccattacttaatccagaccatggtgacgaattacttgattttgctaaccttgatgattctaccaagagagccgtttgggcggtgttacgacaccttcctcgagacgagtctgacggaagtaagttgattaggctaacttcctcttttggcagccgcacactacggcatgccttagtcaagactagttccggggattttgtccacggcaggattggtaatgcatctcaagagcaggatcagcttacagtagatgagttccgccgacaggctcttcggaacaaccttgtttcaagaaacgcccaccaacgttttagaatggtcagcgagaaggtctttctatcagatgactctccaaagaagatagtcgttccaggccaggcgtatatgagtaatcataacagctctctcccggatgcagtatatcttacggttgctagttctgatcgtcttggtggtatgacgatggatccgaagcttgccagagacccagttgaagttgagattcgaacacagacaaccgtgataacgagagatgattttcctctgttgtatgtggatagacaagcgccagagggttcccacactactgagcagaagcgttataaaacgtctagcgctcacaagctatcatcagatatcctaaaggaaaggctacattttctcgcagattgcaccgtggcgactggtaggttgcgtagtgcgagtcaatctggtattaagtcacatgttgagaagactctagatctgaaacagatggccgttgggttaccaccaggcacttttacagaagcctcagtgttgaggttccttaatggagagaaagttactgggtatttctcaggtggatcatcaatctcgatggatttcatctctgaaggtgttgtttcagtcagaatgataatttctggcgttgaattggacgttatcttggcaatcagggttcctcacactagattgaaaggaaagatcttgaggatggccgacctcattagagtaaagcctccaaagctctatcctgtggctgaagttgtaaaaatagttactgtacgaagtatcaacaacccagaattcgttagtattcatactggtaagaatcaattctacccaaaaggcgaccattttatggtcagctctcataaggaatttgattgggttaaggaatctttggatgaggctatacgcaatacgagtcaatggactaacttcatgaagctgttcagaaataagagggtttttggcatggatgaagagattgattttgaagtcccatatccgggttctcaggctacaaagacactccagactactactgaagattacaatatccttaagtatggtcttgaggttgccgatactcaactaagggatgacaagggcccaggagtggacgtcggagctcggactgacgcactggatctttttaagatttacgtcctccatttagccaataggatcaagagcaattcaggtgatcgactcgctagcgagagcggatcaaaagtctctactggtatcgaaagtctcttagctgatggaacaggcgataggttaatgacgagaatgactgaataccttgacagtaatgggggcgtagccataggtcctatgaatgatttacacgtccatgaacattgttcctatggtatcaccccacctggcaatggctcaagaaagatgtccagtggtgcttttggatcgcgaagggatgggaaagtaaggaactattatgatgtcatcacagactatgcccggcttaccaaacatcgtgttaccgacgagaagggcaaaatccctgggatagtaatgatttcaactgaagatatcatggtgcgtataatactttcgactctatgcgttacaatgtattatacggatactggccctttttctacgacaattttgagtaggtcacgccgttccgcctacaccatgcctccttgtattactgggcttgggcttctctattggtctctaccctcaaacctcatcacaataaatagtgctatcccaaggattggcctatcaaagagagagactccaggtattagagggacgatgttcaggtttggtcaaggtgagaggaatattccaaattatgtggattcaagtgctgggggaggtgaaactcgaaaagtagtcatggcttctttcgataacactgatccagtcttagttgcacacaactttgccactttaattagtattgagacgcgtgacgattgtactggtagaactcacactattattctaccaaatggtaaagagatctgtgctgatatccaaattgcccaattggtcagagctatggctgcgggttctcagccgcttgactgcgtgttttggtgcccattctactcaatcactgtccatatggatcctgggaggagacgggcgttagcttgcatcgtgtcatctcctcgtccatctagggtaatgccagtgatgagagacgaggggggtctcaattcttcacacttagctactctgagtggtcagtccatgggcagagatattcgcgttccaattgcggctactatgagaggttcaggttttatggagccgttcatggcgtgggctcttgctgaaagtaagcgaaaaacgtctgccgcagctgcggcggacgattaagtggacaaccatctatgtttttgtatgtacccgagaaaattacatc

SEQ ID NO: 330 - DNA, 980 bp, Unknown
  derived from dsRNAs of unknown virus
gaagaagttgtgacctatatagttgtagcatcaaagaaagtactaaagcacttacagtttttatgcctgcgcgtcccaatgccgccattccgatctctgttatcggagggcggggaggagtgcaagctaagcctgagctttccgttagctgcgcttctgtttcttctgatggttctaagcctgactacaaaggaattatcggttatcggtgcacggctgatcttcagaaaactcagagagagcggattaagcgcgaaattaccgcgcttaagacggatattgagactgggatcacccgcgccgcctccgaaggaagggcaggatctgagcatactatcagcagttccgcttgggacatcagcagcgcagcaatcatcgattactttggaggagcagatggccccctcattttcagtgtcgataactcgggaaactccaacgtaaccatccgtgttactatcaagccggatccagtgggtgttgatgttgactctatcgttaagagtgcaaacatccggtccatgggcctagatctgatcaaccttttcaataagggtaagtcagatctttcaattgaagtgatcaaggtggtgaacaggagcattgaagatcaggttttgtccatctctcgttgcgatgagaagattgacattacgatcaagcgcccgagcataacggagatcatgttttatatgaaaggttttctcacgaaagcacaatcagccggtatcacttacgatgaggataaacttgccgacgaagcgtggaaatatgtcttcaaaggcgacggatatcttaaagaattcttggaagtggagcgaggcctttcgacacagtttagcatgtatgagtcttatgctaatattactgtaagtggatgggaaatctaagtatgtccacgtgttcatgccacgtgggactatatgtcatgcttatggagtgatatctgtagtatggttaagggatcaagtgaaaaactc

SEQ ID NO: 331 - DNA, 1740 bp, Unknown
  derived from dsRNAs of unknown virus
gttttaaaattacacttattcataacgaatataaaaatttactaaaatttatcatataaaatatggattttattaaaagactttcgcaagctgacatttcttcaatcttcagcaaggaaggggaagttaacgcttccggagccttcacccgattacgcttaggccagggtccaactccacgtactcctctgtacaaaaacattcctcaagacattgttcttcaaatgtgggttgacatccttaaccgtatgaaggatgattctgattttgggcccgaagattcaggctacataggagacctgatcacatatgacttatcccgctctgagaaatttggtccacagggagaattaagaccattcgcagaaagagctgaggatttagcgggttactaccaaaatactcattttggtagcaatatcgacgaggaatgtatagagaaggtcgcccttactattttcggtagtagtctaaatcaattaagacctctctccctgaataatgtcattaaacgagatcagtacgatgacaaattaaatacaaattcaggatgcccagatttcacaaaacgtagcaacccccttgttacacataacgcgattcgggatgctgaaactggaaggtggagacattatccaatgtgtttaggctctagatcacagagaggaagtgagcggttcatcttcatggctccgtattcaatgaatcttaaagagaaaacatacctatatccgatgttggatatggttaataaattaggcgtgttagaattgtcagcatggcggggcttccctgaagtagaactaggtttcgctaagatgggattctttcgagaagacaaggcttatatgcaaattgattatacaaaaatggataaatactacaattttacctgcaattctattgtcacgaaagtcgtcgaaaagggctttcaaccaagatatcgtgaagacattgcagaagtacttgaccattatatggaagtacctatcctaatacaaattgataaaatgatcgcagatccaaaaggccatggtatgcctagcggttctggatttaccaacttcagtgagacgttggtgtctttgtatctatattatcttcttcaaaaactagacccgagttatggtattgaaaattgccaatgcctaggagatgatatggtaatctcattcgacagagagatcctcagcaatcgcgaggagggatttgaaacaatcgctaagtatattggagacactgcgaagcaaaatttaggactagaaatgtccgcagaaaagcagcgagtcgactccattactacagtttacctacaacgtttcttcgacgagaggattcgcgacgcagaaggagtagttgtaggatgttaccccagtattttagcgctaaatactgcagtaaaccccgagaggtaccatgatcctcgaaaatggagtaaagaaatggagatacttcgatggctaatgattctcgagaattgtaacaagcttccttacttttccgaactagtcaaattctttattaagggtgataagtataaattaggattacttattccaggtttcttcgattcgttaaccgtaatctacgaagaaggtaaagctataaagggttttgtgccaagttataacaatgatttcaatgatcgtgggatcatggatttctatgttgttaaatacttgatacaaaatcgctcggcgcttgaaaacgagtaacgcttgggtggagtctctccacctc

SEQ ID NO: 332 - DNA, 1406 bp, Unknown
  derived from dsRNAs of unknown virus
gaatattttgaagaaccacagcagtaaaataagagataatgagcacaagaaacgtactcgatattttggcagataccatggatgatcatgaggaagatcgactggaacatgatgcccgtgaccatgtactggaaaacgcccaacttgccgccactgactttgaagaaggtagaagtgcattggatggattggacaatatcaggggatgcgtaaacaaccccaccgataacgctttaacctcggatggggaaaagttatttaagtttatcggtcattcatatacgctcactgacgaatcaattgagaggccagcagaactacttatggaagttgagctaacgaaagacagattaattcaggctaatataaatatgactgagataatagaacagactaacgaagtccatactcgtaggctagaccttgataccgaatatcaacagcacgtaatgagtgatgtaccggctagtagagctatgttacgctccgtcatgtctgaaattgaggatgcgaatgagcgaatcaatgggttgtcagatgactatgatcggtctaagcgatacgcaagacaagcccaaattgatttggactctgcgcattacgaattagaccaactgcgtaaggtcaaaattactaaggtcttcaacgctagggcgctgttattcacagacccaaggtggaggggatactcagtttatgacctaaaacttagacctggagacaaacagaccatgaaagacgcttttgtaaaaccagtcctatcagctctagatgcactcgatggaaccgagaaaggtacaaataacgccattcaaggcgtagtgtcaatcccgaaaggcatttttacggaagaaatcgtacaagatattcatcgctttaagcaatctgaggccgctaagaaaattggaaatatctataagttaatcaagtcgttgaaagagggaaagcatacacgcattctttacgacgatgtcattttagccgattcaccagaatatgcagaagaaaacgcgttaataagtgaaatttatttcttaaacttaactgctatggctggatatgaccctaagagctgggcacaagcgtttggagtaccaattagtggaattggggaacaaatcttgagcgaatggggtaatggccgtatgggaccgttaaaacctgaacaaataatgagattatttgaaaataaatcctacgctaaaacttcatccatcaactatcaagagttggaacttaaactttccaaggaagacagaatgaaaatgaaggagggcgaggtgcaaagccttgcgagactaattgcttcaattcaaggaaatgaaggagaggacgagcaagatttacagataatcgaacaactgggcagaacggactaatttcatactatcttcaaatgaaacatc

SEQ ID NO: 333 - DNA, 1525 bp, Unknown
  derived from dsRNAs of unknown virus
tgtaaaataactctatttgagttaccttattattaatactttgtattaatatggcagtcttaatgcacttactttattgtatctgcaatgagacacattcttatttgtttacaaataagacaacctgttacttcggtaacattcctttagtaaacaactgtttactatattatgtagtgatttgtcaccctacataacgaaataattggacttaaactaactagaaatatcatgaaaacattcaatgataaatcggacgttaagaaagaccacgatggagatttctccaaaatggctaataactttcagatacatccgtccaccgatatgcaagtggttaaagtgcgtataaaagttggacctttgttggttcagtatgccgagcaattgattaagttgcgtagtgcgaaaaacttgacttgtcctaaaaaggaggacttgttaatgttctttgactcgttgatcaaggcaaggatacagcaagtaaccaacgataggtgtgttttaccacctagctccaagtcatggaaaataccaaattttctaatgttcttactagctcgaatagggcctgtagaattgccgaaattcaatttggtactagtacctgagtatgtagccagtgagtatgctttcgatgaaaagaaagcaaacaagaaatcaacgccgagcgatgaatctagtttcatcacccgcatcggctttctgttgttttctaaagctgaaaaatcttgcggtgagtgtctccctttcagtcaagaaggagattctgacttcatgtgtttttggatggtcggtgacaaagttgtcacttatcatactgaagcagaacccattatagcattagcttccgcattcgtggatgcgcagctttcgcgggaatgtttcaaactgacatgtgaatatggttcactagactactttaagcaactagttcctgaactagctagcgatggtttagtgtctacatccgtctaacttttacaacacctgacagtattaggttaatttattgaatagtaatttactaatcagtaagactttactatgtaaagttaactatctgtatattgtgtctgttcttccgtactttgtacgacgtcttttatccataagattaacactgtgtgttaaaagaggactttccatgcaggaaagagtgaacagtataaatatagaccagttattctggttatcgacttgttgaaagccgagactagtgatgacattgttctgtacaacgtcaccaatgatactgaaatttcattgtgtaaacatttattatgttaattgtgatcaggaactttgagttaattctcttcgttttactattaacctctattatctggatgagtacgttacaatggcgttctgttatactaagttgtttttcttaatagatgttcaacttacttgacagtaacctaacgctaatttctatttaactgtagaaacaaaatccttaattgcacgctaaggactagaatagtgcactcctatataaaagttaatttatatagggtca

SEQ ID NO: 334 - DNA, 900 bp, Unknown
  derived from dsRNAs of unknown virus
gaatattgaataacgaaagtgaacgaactgccgattttaattataaatcaaatcaaactatgacggacgcaaattccctaaaagataacatcgaacgcgttagaaaatggaaagctgaagaatataccgatgcctcatctatcgcaacaggaatcgaacgcgctcgggccgtaatatccaaccttttgagtgggatcacacccgagaacgtagaggggttaacgtgggccgtaggtgaaattggaactacagtaacagaagtgcgaaaagcagtaatgcaatgttcaatttaccaggcttcctcagctggtgagcatacggcaatggcaataatatctgatgatattttcacagctctatggcaactgaacaacgacttactcaacgagcgattaaaaatgctggatacacgcaggcattacatgcgcagacgtgaaaccagaaacgttgtatgtgctgcggtggaaacgtctttcatgtttacaatgtttctcactaactatgaagtgttagttaacgcaacgggtgatgtagtacgtggcgccgctaactggcatcatcatatggctttaatgtttgaccagctgtctgctgcacagcaatatgatcctgaaatgctgaacgagaatggcgacgtatcagacgtgccagctgaaattgagcttgaggacatgccgagattagaaactgtatcttcagatataaccaaccctctaactgaaattgaggagcttgaagtgacaagcgaatcaagtgagggtactagggcccagacggtcaatgaaattgtagctgaacttacgaagactaaaagtccaattgacgtataatagtgattttgatgcattttaattccaggggtgttgcccaacttgtcacttttgttatacatgtaacatc

SEQ ID NO: 335 - DNA, 1523 bp, Unknown
  derived from dsRNAs of unknown virus
gaatagaaatcccttcccacgataagtaacatggaaatttatgacttaagagtcattgaacgtacaaaaagagatggtttcagagccgccacagcaggctacctgataaaggtgctctcacaagcgctaaatgtcgatgttgacggagtaagtagcaacgaacgtttggatgggctagcggatcgaatgggagtgacggtgcatgtactcaaaggtgagttgcgtaaaattaatgaagcaatgagagatagagtcactcctggtgagatatacgattttagcgagctacgtaagcacaaaggtaggatagatttgcaatcattattgtgtaacggattataccataatgctgatatcactagatacgaaatctatctaagctatatcatgcccgcaaattcagatagaataatatattcaaccgacattccaattacagagcacaatggttctctaaccattaacgctcagcatggaggccgtcaacttattcactatgcatctactgtaagtgatataatgacgatgttcaaatatacaaagtttagattgcattctaacgataaagtgttagtgatagatggcgtcggagttgaatcgaacgccaatggtatgatgacactagctataaacgttgacactacgcagcatgctaaattcgaagaggtgttaagattgctaatgacagctgactacgtaacttactcctacgataaagtcgcacctttcataatcgaaagaacaggtttggatcaaggaacaatagttatgcatgtattcccacaagatgacggatctgcattaacgaggtggatgaaccactgtgagaaatcattgaaacgaatgctcgtttcgattttaaccacactcaaagaccgaagtgaagcatactcagcaaaaggactagggggccagttccctcttgatttttacggagttctacgaggtacgttagacaacctggatccgacgaaaagtccaaactcgagtacatcataccatatatcggatagagtcataatcggcgagcttttccaagcatacattaatggagtaacaaccggacgtatgtccgacaggatggcaatagcattccaatgtctaaaagcgcgaaacacgtcggatacacttatacacctaaaagggtttattatatcatacatatcatttgcgactctgtttcaattatatgataacattatgacgtttaataaagacgtgaatggtgtaaaggacgcaatcaaacaacagtctgtatccaaacaaataacaagatttggacttgatggaaaaagagtgcttgacgatgcgagaagcaccgcaactaccattgtcaatagcttaccatcctatagcgatcagaagatgagagacacgatagagcgagctaccgatatcatctcttcagtacaaaaataccttaaatgatgaatcgaatgttactatggatgatgaaaagttggtgacgcttccctaaactcatacctatagtggggccggccgcggcaaaggatggtaacatc

SEQ ID NO: 336 - DNA, 2341 bp, Unknown
  derived from dsRNAs of unknown virus
gaagaaagagatagtagaatgacaacaaaagtagaaaatgtagaggtgcttgaagaggagactgttgatgacgaagctctgctcactagtgttagtgcgcaatatctgggtctaggagtgtttttcaacaacactacgttgtatgtgggtgatgatgtgcaatccatttctctgcctatgcttgaactaactgaccgtctccaagatgttgcgccattcgcaacacctgttgcggcacgtctgattcgtgacgttagggagacagctctaggtcgggcgatcaacttcgatctatatttcaaacggtggttcgagataaatgggatgcgatgcactggtggtcaagtattccctgagaatcggccaagggttgaggttgccgaccttcagggaaaccttgtgtttgagagagatgatggcgagaacatagcaactgctgcgtttcgtaacgtacctggcaacattatggtccatcatgacaacatcagcaccaaaatgccatcgacgggctattacgcttataagcgtgatcatgacatgcggctaacgtttggacgtgaaaagactatcagtgacggtggaaagattcgcgttatcgtcgagccggcacttgctctgacagctcatatcactaagcgtgtgaatggtaagcaagagaagatgatcagcgagagcgaggcgagacgattgttggatcagattcccgaccagtatgacatcttacctatgtacggtacgactaacacaagtgggatcgagcttggcaacagcgtcacctttgatggttcggtgtaccatggcgtttttgcgttacggccaaaagagaatacaggcgttacgccgatcaagatgttttcggggcaagccgtgatgccgcatcggatcaagctagtgtgtgcatacagacgagctggagatcgcgtgaccgcgactcgtctgatcacaataattgcgttggacgcggttgaacgtgtggctgtgctgaacctgccacagttcactacgcaggaggcggaatatgagcgctggaagcatatacatcttcagggatgtgttctctctaagtcagagatggatttgctttcgataagagcttcaatcacaatgcgttttagtcgggtcccgatctgtttggtaagtgcatacggtgaggttacgcatgtccctgagatctacactcgtttccaggtcccgggaagcagtctgaagatcgcttttgaccgcaaccaggactcctacaatatacaacgggtggcgggcatcgagattcacgatgttttaaacacgttgaatctgtatcggaagcgtcatggtcaagttgcatatgaagtgttgattgactctggtgtgcgtgcatgtacgaggcatatgttaagtttgcgttcctgccaacggatgagcctatcagtttggagagtttttcgtactacgtacgatctctcttgtgtaacagtgttaacataggcgcacataacgagttaatcgaattcgtcgatgaagatggtgatgcaatgtgcaccaattcactacacatgtccttcgacgtttttatcatgtatcacgtatattgtctgacacatcacgtttgcatcagagatagggaaggaagtgagtcctcaccactaatcatgagcacggcgatagccataccttatttctgcccgattatgccagacgtgagggggtttgcaatcagcgaacctggtggttggacttctggtctgttcaaacatgtcatcagcgacattgtaaatgcttgtagatcccatggcgtcgaatgcccatacaagagattcacgcaatcgttaagcaggggccgcctcgaactcattgggttcagtcgtggcgttctggctaatggtatgaatgaacatcgtgaagtgcaaggcagtgtcgtcatacggacgccttcagatgaatatatctgccttgatcatgtcatacgtgatgcagtgagtgttcttggagtgcgcgcccgttgtgggataatctatgatccacgcttctccatgttcatcgtgggtggtaatggaaatgctgatgtcttcatcaccacctcaactaagctggcacgtctacttcctagtaccaaaaactcagactctcttgttactcgcaacgataatacgttagcctatgtgcatgagatgatggctgaaggttcagggtacattaggtctcttgacactggtagatcgtagacaacataccaaacgtcattcgtttgatggtaacgtatgtgcatgtccggtcttatcattgtcaaatttctataaacatgttttaccttaggttgacatttcacctaagggttctacaccgcaatatctctcgaaaactc

SEQ ID NO: 337 - DNA, 3554 bp, Unknown
  derived from dsRNAs of unknown virus
gtaaattttcctctcggaaactcctttcccctcctcaagggtcgttacaacgaaaggcacaaactaaaacaatcatttatgaaagatagctctgacaacatcagtaatcttagtaaattgggtttctcaactgatgaaattcaattactaacggatgctgaaaacaacaaacttgatgattccaaagccgaagagttgcatgcagcacttcgcaaaatacacaatattttaggaacattaacgatcaaacataatgaagaaatcgagaaatcaagcggcaagctaggtttcatcccaggtgttaatccaatcactaagttcgcaactagtgtagcggctgacgcacttggactagccggtaactcaccaattgaactgatggacgagggcatggctgccttaggtcgagcaggttcatcggcaattaacgctaagaccggaatgaaagtttcgcctgacgtattgacgaaaaccatgacttctcttttgaacggcgttgctgacgacgtattaacaaaaggatttactggtgctggtggtggtaactccggtggcaataccaataatccatactctcctggagctatggctgctggtactggtttcactttcatacctaaacctatggaaatcagattcacgccaaatgtacctaatactgtatatggagaagtaactgtcgcaccaaacgacgaattatcttccacttcagatcagaatattagggctagaatgcacatgaactgtattgatttatctttaccttcatttggattcggactaaatgacgcaaatgttaatccagtaagtagaaccgttactacttggtttagaactgtctttacgcctaatttacaaactagagcgcaagcgagcgtagctttcaacatcaatgcacaaactcacttcactgctgacagattgcatacgtacgttaacacagtgcttaaagcactatctatttattacttttatgcacatacttacgcatatactgccatctctacgaataagaacactgcgatgtatgaattgcgtgaaatcttttcgacttctgatttacagaaccttcgtttattagaagagagacttaatggaatgccgattcctccgaaattgaatgaactttgttactggatgtttgatatttaccgatcaagctcagttgctggatctgatttaatcaggttagcaccttttggtatcaaaggcgcagattctggggatactgttgccactcaaattattgatggtccaacacttatcaaaactcaacttaatgctttgagtgacttaaactctgacggaacttcgaacggcagaaaagttttagttactggtgatttcttagcacgcgtttgtcctgattgggtaaacgttaaagttggttcttcagccggtattccattacatgatccagcattaactactttattctggaaccagcaagtaacttacggacaagctgatgatgtccctacttacatgccagtctttgttgataacaacacagacacggcttacaactcgtattgtgaagaattagatggtgtagtccaatctatgttctcttggtacagtgctgcttcaactagtaagtttaatgttggctgggtgaaagccattccttgtgacgttggtggccaatggacaaatcgttttacttatggtaatggtaatgcgggatttggtttctacagttacacttacacccctaatatctgggcgatgcgtaatgatacctaccgacctggtggttctacaggtactcaactgactaacattgtcggtactaaccgatgtgaagcagttccagttcttggaatgaacgttaattccgttcaagaggcaactgtctcagcactagattatttacttagtattggtcaagtagggtctaaagccccactttcttctgatattgatgacgagaaacctttaaaaggtcaacgtcgaggtagaagacgcaaataattgaatttaaattgattatgaacaaaagaattacatcccttcctttcttagatgttattaatgaacttaaccttggtaataacacttatgctaaagagaagctttctaatcttttgaccagaacaactgttggtagcaaggatattcttgtctctcctattggcaaatatggtccggataagcttttaagtgaatggcgttccatatttgaggaagcagtaaattcaggtaaggtaagtaatgaagtacttattggcatagaagatgcacaagctgataaatttagtccacgttctattgctttaccttggactaaacgtaaagctaatgttgatcagtattttatcgaaacaaacatagattactcaagtctagactgttcaactagtgcgagtgagagtttgagacctcttaactacattaatgcttccaagtttataaagaaatcaactagtgctggtttgcctagtatgagaaagaaaggtgaagtactcgaagaaaccgttaaagacattgagtactacttagatcgtgaagatcctgctgttctttatactcgaactcaagaaagcgcgaaaactagagacgtcttcggtgttcctcttgctgacgtattaaacgagatgcgttattatcgccctattcttgagttccagaagaaattaatatggcgttctgctttatcaggacccgaccgagttgctaagcatctaactgaaattattgaacgagccattagtgaaggtttgacactgatttcaatcgatttctccgcttacgacactaccataaaacaaggactacagttcaaagttggacaatattataagtcactatttcaaaagagttatcactcagaaatagataatattataagacggaagagtaccataggacttgtcacaccagatggcgttatgactggacctcatggcgaaccgtccggatctgcattcacaaatgaagatgatagtttagctcaacactgtatagcaatgtcatccaatgcaatcatagaagatcttttagatattcaaggtgatgatggcgtttatgccgttaaaccagagactgttaattcactctacaatactttcaagaagtatggtttaaatgtaaatgttgataaatcgtttgaaagtccgaactatctcgtatatctgcagaatctgtatcatcccgattttaagagggacggtgtaatcggtggagtctatcctactttcagagctttgaataggatagtttatcaagagcgatgggctaactttgaggattacggcataaaaggtaaagattattatgccattagaacacttagtattctagaaaattgtaagaatcatcctctgtttgaggagttagtcaaatttatcctttctaaggacaaatacaacctagaagtttcttctcgtggtgtcaatgaatatgttaagttcatgattgacacagagggcacagaaggactgataattaaccagtacggtgacgacctttcgggcattcgaaattggcagtcattccgtcttgttaggtctttatcaggaagctagtactctgggagttgtcgactccccccc

SEQ ID NO: 338 - DNA, 3613 bp, Unknown
  derived from dsRNAs of unknown virus
gtaaaatataaaaatttaatttaaaagaactttgattccccgaatcgctcccactgaaggtcgtgatttcaatcatttttacatgatgtgggttactcacttaacacaaggcgttttcatgaacaaggaaacaacgaacacagatgtcaaacagtcttggccgacttattctgaatatctacgttattgcaccgaaattggtatcaactctaaacttagcaaacaagaatggaatgatttcgagaaagagatagcttctaaaactgaagataaacactatcacggtttaggttttatgcctggcccagcgtttagacctagtcctagactgtctccaatcagtccgattaaacctggtaatagtattccaacaaattcaccaattaaaactggcccaccgacgcctcaaggcccgtctggtatgtcaggaccctcaggtctggttagtgatttgtttgatttatacagcacactctcagatccaactgtccctcctggtgacaaagccggtcgtgttgctactactatcattggtttacttgatgcatctgctgaagcaagaggtggtaatgttaaagtacaaaaggatgagaacgaacgtaatttagcgcaaagctatcaattaaagtacgcagcctttagtattaaaccgccagctatcgaggtaagttactctcccgacattccgaatactgtattttcagactattatcggactgtcaatgataaagatgccaacgtgtatctttcttctaatgtttttagaattccgcaagatgatcctgatattgaaaactatatcaacaacatcttaattccggatcttcaaactagagctaacgtaaacgtaaacttcaacgttaacgctgaacaagtgttcacccctgctaaggtgacatcgtatatgtctcaagttatggttgcaatgcaaacatactattcgctagcgaatatccttgcttatcctgctcttgagggtaatagcaatacaggcatgtacaggcttagaagtatgattagtgctgatgatatcaacgctcttaatctactaggcgaacgactgaacaatatccctattcctccaagacttagagagcttgctttctggttaagtggtatttataagtcaacaaatcaatgtcctaactctccagtcttaatgattaccccactgacttttgaaaatttcaatcagtatccgtgggataataacggaaatggctacttctcgcaaattaaatctagcattcagtttctgattaatgcccttaatccagatgctactgtgtcaggctcttgggatggtagattcgttaacatgttagccaaagtatgtcctggatggttaggtgctgagatgggctcatcgtcaggtattccattacatgatcctcattggatggatgtctggtcgaactcttcatcatctgtcactactgctgattctactggtgctcaaaaggcggttcccgtattatcgatagcacaagacagaggtgaaactattagatacgttacacattgtacagaaatctcaggtattaatcaagctctattttctacctctttaggtaacaataactggagtggactattaatgccagctgaatcaacggttcctaatcaaggttcagacggcactccatactacggcagcacgaatagattagttttctcttcgggcagtggtgtgggtgaaggagctttctatccgtactacggatcagcctcaacccagtctaattttcaagacgacggttatggctttaactaccctgtttcacagtcaggttggtataataatccaggtgcgggacttgctaacaacttctacatgccagtggattgtcaacccgttcgtggcatgaacttaagttcgaatttggatcccagctacatgtcaactagatggctaatgtcatttgatgaagcgttaaccggtatctctagaacaccgagaacttctaagagacggtctaacaagaaatcatcaagtgatttagacaaaatggactagttggaggtaattggaatggatgatgctaatctaattggaagcactattgaagaagtttcactgcttgtaggaaagcgctttgattctgatgctaaacaaaagcttaccacgcttctattcagaacgatccaaggtagtaacgacgttattctttcaccgatggctgagaagtatggacctaggattcttcttgacgaatgggactctatatttactagtctcggtgattcacggatcgaagatacattactgaacattgagctcgctcaaaaggaaaaattctcgccaaggtcagtagctaagccatggtttcctgagcgacagaaggacttagagggttattacagtagtaactctgcagattactcagttttagattgcagtccttcgaacttaaatttaagtttacgacctttaagcttagctagcgttaaagatttcataaagaaaagcacatctgcgggtcttccttcaatgcagaagaaaggaattgttttagaccaaactattaataatttcgaggtgttattatctgacgccaatagactccgcataccttgtgtcattttcacgcgtactcaagagagcttgaaaacacgtatagtcttcggtgttcctctaattgtggttctcaatgaaatgcgtttctatcaacctgtcttgaaggtacaaagaaatcttacttggcgctctgcgttaaggggtccagatgaagttgcgtctcatcttactgctattattgatgaagctaaaagaacaggaaacctcctagtttctatcgatttctccaaatacgatcagtcgattaaaccggaattacaagccaaagtaggtgagtattataaggctatcttccagaaatcattttctggcgatattgatgatttaattaaacttaagtctgaaattaaggtagttagtccgactggtataataagtggtggtcatggagaaccatccggttctgcttttacgaacgaagacgactcgattgctcaacattgtattgctcgccacagtaacattccagttgaggggttttatgatattcagggagatgacggagtatatatgatcaatccagattcatatcctactttcgtttctaatttcaataaattcggtctcgaagttaatgaagataaatctactactagtatggaatatcttacttacttgcagaatctttatcatccgtattatcgtcttaaagatgataaaatacctggggtctatcctacttatcgtgccttaaataggatatgttacctcgaacgttttgctaactttatggacttcggtttgcaagggcgcgactactttgccatccgaactctaagtatcttagagaactgtaagtatcatccatattttgaggagttagttaagttcgtcttaagcaaagacaagtacgaactatccccttcagctaaaggaatcgctgattacgtgaaatttgtcagtgaaacagagggctttagcagtgacatcatcaaccagttcggtgacgacatcaaaggcatcaagtcttgggagtcgtttaagctggttcagaagttacgggcataaactctggggatcatttatgatccctcc

SEQ ID NO: 339 - DNA, 1629 bp, Unknown
  derived from dsRNAs of unknown virus
gaatattatgattactatttagtgttctggaaatgaatcctatcttaagagagattcccatcttccacaataaggtagatattatatcaaaactcaagaagtggaacccgaccgatccattaccagcgcataggagatatttaactgatctcctaagtggaaaagatacatacgaagcagtcagatcaggatctggggtagtggataaggctagattagcctttggtataataaattatattcctggagagcaaggtcacttcactgtggaactagcaggaagagtcgctcctacaaacgatcagatagctattgagcttggatacgacgagaggcttggtattcccgaaggaaactctgtggaaaacccacactacggagcaaataatacattatacgaaggctcaaacacaatattgcgaccatacgagccagcagcatctgtgtttttggtaaggaataacttcaactcggcttctgatagcgagctagttgtagtacaccgtaaggaaggtccgcattcaattagagacgctagccgcctgccaagactaccccccgttttaacgtcgtcggaaaatataccaatttccttcgactttgacacacaagataagacgaaactattgataattgggccaccctttgactatagaggaggtgaatcaccatatcagcaaaggcgaccattcatcgcatactcaccccaaacaactaaatcggaatatacccagattgtacgtgatctacctgtgggacgatcaacgacctggctcgagttagaatttgattcatcaatacgcggagaggatacagtagttgaagtcttttgaacataaagcgtaatggacgcgcaagagcatagtgacgatgactgggaagccactgaaggtgtcctacaacgacttaaacatagctgctttgcgatgcatatgttatataggcgtagattcttcgagtccaaaaagcgcctcgcatactatgatgtaccaataattggactttcagctatgaacagcgttcttatcgctggagggaaggattttatacctagacaagtgctacaggtgttgacatgctttcttgcggtaattgtagggataattcaatccataaagaactactttaaaattgacgaaaacagagaaaactgtctggttacgttcaaggatctttttaaattgttctgtgaattatcgataatgcttgatcaaccacggttcgcgagagcagttgacccaaagaagtacaccattgataagggaaatgaatatcaagcgatcatgtctaaagctatactgttggaggataatagatcaaaaatgaacccgatatatgaagataatcacccgtatactcctcatgtaagtggcatatcacagctatttcgtggtattaggagtgagacatcgtctaaaatagatgaggaagcggcaacaattgaaagacaaacgtcaatgctcccggaaatcaaaagtatggaagagatcccaataatacctgacccacgtggtgacgatgagatataactaaagttggatacatttcctacgacattatgtcgaaatgccgtgctaaatgggtaagcccttaaaacaggatgccccttgcgaaatcatatgaaacatc

SEQ ID NO: 340 - DNA, 965 bp, Unknown
  derived from dsRNAs of unknown virus
gaatattatacagtatagtgaaaattgtttatttgcatgtgactttaagcttgacatggttcttgatgatgatgttgatcatatcgaacttaattcggaatgggaggctacagaaggtgttcttcagcgtcttaaacatagctgttttgctatgcaccttctgtataggcgtcgttttctggaagcaaagcgtaagcttgcttactacgatatccctattattgtactttccgctatgaacagtgtacttatcgctggtggaaaagactttatccctgcccagatactacaaattatgacttgcctgctagccgtcgcggttggcataattcaagcaatcaaaaactacttcaaaattgatgaaaatagagagagttgtctagtatcatataaagatttattcaaattattctgcgaaatttcattactattagatcaaccacgatactccagaggtattgaaccgcggaagtataccattgacaaaggtaatgaatatcaaacaataatgaataaatcaataatacttgacgataatcgatctaaaaggaatccaatatatgaggataacacaccctatattgcgcatagaagtggaatatctcaacttttccatgatgttccaaatagtgaaggctctgaaagcgagttccggctatttggaagaaagaaaaagaaagaaagcatgaaaactactgaaagtatgactgacttacagaggtctccatcattactacctgaattagagataattgaggaaaagattgagcgaccaataactgaagcagtagaaacacaaacaacagcagttggtatcttcatacgagatgacaatgaaattaaatcaggatctgagtcagattaatgtgatgtgaatgaaacggaagcgatgtcgacgtaaccgaatcactatgttatgccatgataaaacatgcataatatcatgttgctgtgtatgaaacatc

SEQ ID NO: 341 - DNA, 1702 bp, Unknown
  derived from dsRNAs of unknown virus
gtgaaacaaacacaaatcaaatagcattatttgtaagtcaaatatataatacataaacatatataatcaaatgactattgacaaaattacgcaagcagaaatcgattcgcaactaactcctgctgcgcagtcaaacgcttccggaaattttctttctattaacgctggaaaagcacctacaccaagaactccgttgttcaaggatttatctgaagatcaggtattggctgagtggtataaggtacttgaccgttatgaaagtatggacgtttatacgccattagtagagtacgacaaatcgagacgttctaaagttggtcctcaaggtggccttcgtccgttagaagagcgtatggatgacctcatggcatactggaatctacaaccctctagggaagttactgacaattatttgtcggatctagatgaagatattattaaggagatgcgagatgaattattcggtgtcatctcagatcggagaccccttactccgcaaaccgtgattgaacgggacttacgtgatggtaagttaatcacaaactctggaactcctgattacggtaaacgtaatgatccagagataatagctaatgcaatctcagcagtacaggatggatcttggaaagattattacatgattttgggaagtcgaagccagagaggtaaagaacggttcatttttatcgctccattcgcactaaatattgttgaaaagatgtatttatatcctctgatggatattattcgctcacggaatattccgttcttctcagcgtgggagggttttgcagaagtcgaacgaggtttcgcgactcaaaactttttcaccgaaggtaattactacgttcaacaagactacaccgctatggacaagtactttaacgaggcttgcgccgagctagtagccgcaatcattagccctgtattccaaaaatcgtatgaagatgaccttagttatcttttcatacaacacctgttgaacatacctgtcatgattaatttagataaaatcataagtggccagcatggtatgccaagtggttctggtctaaccaattttagcgaaacaattgtctcaatgtatatctgtaagaagcttgaacgtgattacgacttacaagtatcagcctgccagggcttaggggacgatttagctatatctatttcaacagatttagacccagaggacatcaaacgtattcttgagagtaattcagcagatcttggtttgatagttgaaccagaaaaacaaggaatttctcaggacacgatagtgtatcttcaacgcttctttgataaacgtataccgaatcaaggtgcagtgttggggatgtatcccagtattctcgctttaaatactgcgatgaatcccgagcggtatcattcacccgcgaaatggggagcaaagatggaaactctccgatggctaatgattcttgagaattgtaagaaccttccttacttcacagatctagtcgatttcttcataaagggagacaagttaaagttaggacttgtcgaaccagatttcttcgttacgttaccgtctacctacgaagagagtaaagccattgcaggctttgtacctagttacaatcaagaatctttggaacgtggcatccaagattttgaagttgttaagtatttactaagtaaacgttcgagcgtttaaggcttgggtcagattccatctggcctc

SEQ ID NO: 342 - DNA, 933 bp, Unknown
  derived from dsRNAs of unknown virus
gaatatatttttgcatagactataggccatgtttacgtttcatcgacagagcgtaagcatgcctaaaagagaggctccagaaatgcccactggatgcctatctattgacgagaagatagaagtaattgacgcatgtacgatactaataaggaatgagggagcgattgtcgcgcagattaacataaagcatggtgatgatgggaaaccatctatattcatgatgaacgttaatgcgccatgggacaatccacataaggatgtaagcataatatactctagaatcatgagtgacaaaccagcaccacaaccgacgttaagtgataatttctcaccatgtaatgatatgttaacaattgcatcagagagcgagaagactgatagcaagcgagcaaaaagtgttacatttgaggatatgacatttgaatcggcgaagaaagcgttaccgcaaatcgatacgacgccatcttatacggattcagacacggagtccattcagagcaagacctttgatcaactcgaggatgagttgcatgatgatggcgcattatcaggaatgcaaatgacgacatgtgggaagaaatatcatcttaacattaagaatgatggtggcatgctaattgacatgaaggatgcttatgagtttagaccatcgcttggtggaccaaagaagacaatgagacgtaatatatatgtcattagaaaaacacctaagaatgaggatgagtcatatatgataaccatgagcgtcaagaagccgaaggatgcaattcatgtaagatcgattccacgaggagttgaagtatggatgagaggtccaactaggctagaaaggcccatacaattacttgagaactcagcgcttgaggaagttcgaaatatgttagtcaatttactttgtcagtagtcaaatacagtttatgcaggatgaacatc

SEQ ID NO: 343 - DNA, 1157 bp, Unknown
  derived from dsRNAs of unknown virus
ggtttaaaaaatttctaaacgttatgctacggtcgaaattcttaagaaacaattctgcatctgtcgtataccttcgtgaaggcgagcataaaagttttgtggtatcatgcagagaggacacttatgcggcgcagatgatggcattagcggaaggcttcaaagctaaatggacggaggaattcaatccgcgaaagttgggttcaagggcgagattatctgacacaacgtatcgagaaggtgatgacttcgtgtggaagcaggtaccacgcggagctgaccatgagaagttgattgacgcgactgcgaaatgtctacctccaattacgaagttagcgtttcatcagggatattattgggtacgcattccttattatcatagcccagtcaaatggaacaaggtacgtattgcacaattccttgatgatatcaagacaatgcatgataatgggttagtacatcatgatattcatggcgaaaacgtacgtttgcatgatgatcgtgtagtgctgattgatcacagttgggtaggtacatatgctccaagtgtcgtcggtgggaaatacaaggattatgcggacccgaagttggcggaatgggcagcgattaaagacatgctgggcaaagaagatgaacaatgggtagaggcgatggaacaatggatgagtgatcaaactgaattatatggatatgtgtataagttgttcgaacaggatgatggacaggatgatgaagtgaagaagggaaatgaaactgaagaggagagtgaattgcatagtaaacagaaagagatgtgtctcaacgattctctaacagacgacggaacttagttacatcacatcacttgcatcatcatccctatgaaccaattgatatgtgatcgctatgaaacggaatgtgacgtcactaccaaacagtagagtaacccagaccaaagaatgtgaaacgcaccaggatgcatccgcaacgcaccaagtgcaccaactgtaaatagtaatagtattatacttgacgaatggtgggctttcgcataatatggctaaggaagtaattgtacatactttcatacgatgtgatcgttgatggactgctgaagtgatacataaccttgatcgtagcagcgtgaaggggtaccatccaccccgtgtttttttccgacc

SEQ ID NO: 344 - DNA, 3432 bp, Unknown
  derived from dsRNAs of unknown virus
gaatattattggtagaatcttaggacagatgtcggacaaaacagaagcttataaaggtaaactcccacgcccttccaaaactcaaacagttaaggaatttgaagatgaggaaataaagccggatgcagagtacaccgaattcaattcggttgctgaaatcctggcaaaacctcaatacttcaaactcattatcgatcaaccggagttccaggcgatgctgaagcgagagggaatcgaatcccccgatgcctctgagcccaaagccgctgaacaaaagaaggatgacgataaagaaaagtcgaaagaagttaagaaggcagaggaacctgacgagccaaaaccgaacactgaagaagatgagccaaagacatcaatcgatgttgtaatggtgccatcacttgaagagatcagtcctcctactgaggaggccgtgtctgagatagcggcaacaaccaaggtgttcatcccaaaatacaagcgtgtcatgcacaacttaacgtcacccgtatcaatagacgttacccatggattgggaactcttaaaacgagcggacttgaagatatttacactaaatatagtggtgaccgaaaatcgaagaaaggatcaaaaatgttcaaatggcttcagacataccggcctatgggcgtaattgctccaattaagtatgatgcagtcaccggaatggtctcatctgacaatcacagctatatgtttgatgctgacgtcgccggaaacagtgccactgctcataaatacgaaattaacagactacgtcccaaaatcgcagactcatttccgatgtttactcgaaacatgcgaatggatccaagtgtaccagatgcattgactaccggtgttgaagagcgcacgcttgttgacttatcgaccgaacttcgtattgatggtgagcgactcaagtcagcggatatcattgcaaacccatggaggtttccaatgatgctccgtgataaggaggcgtatagatacatgtctttaacattcgatgattggaggcgtgtacatggcagatacattgacgatgtaatgctgcaatatgttagagagaggaatgctaaagaacgcgatgaacgtactaacactaccttatctcttacgctatatgatagatttgttatttcgaacgcgggagcgaacagccaggattattactataacgtgataccaaattctgaaaatgtaatgctctgtgaaacagttcttaaccgatcatttaacaaagcaatggaagcgatctcaaccatcgcaccatcccagcgttcaattagtactaacattacgaatcgacaagcctctcacatgctactgaacttaacctcagtgcagccaagtgatggcgcaaattttgctaagcacctaggtgcgttcctccttggtggtaaaaggcgtgctctggaagttgatatcgacgatggagccaccaaaacgcctttacttaacgcacttagtagcttcgcctctctaattatgttagacgaacgcttcgttgatgagcgcacttataggcagttgatggtgaacgtgcttctacctttctttgatgaatttcaaactcaacgtcaaggcgatggtggtgttagggtgtcgaagggtgtacaccaaattgctgatgatctcatgagacttgaaagagtcgagctccctgaagtcactaaagttgtggatctcgctggtcgtggacgtgcgcgagcacgcgaaattaaagcgatccttactaacctcctaactagattgagggagacgagatacgtgcgtcttaatgagagagctcaactgttcaagacggaaggagcatcaccattcatcccattcaattcacgcgatgacattgttgacattgtgctgtttggaacgagaggtgatggtgaagaatcacgaatgcatgaagtcagttcgtatcgccctgaagccatcaggatctcttctctacttgaggaattcgctgatgtactcggtcgaatgcgtcaatatgatggcgttggacttgctctcacagaagcaatgaagactaagacgcaccttccaatgtcaatggctattttcaacgacgcttttgtgcatggttcaacaaacactgagttgcagccagcagttgaccgccgtgacattagagctagaggtacgattgactcagttatgttgcccttcgacggtgcactttctttccttctgtatggaattggatcatccgaggttgcggaaaccaacaacgctttcgtcagattcaaagcgatgacaacacctctgatgccttctctatacccagtatatctctattttgagagggccatcgcgcaaagcgcatatcgtgaatttagtgatacacttcttattactcatcgtgatatggtggttgaaggttgcattgatgcgcttgctgtatactttgagagcgttgaccccgaatctaaggagcgcattgaatatctattcgatgaacgtcgtaccttagaccaagaggcaggatttgaacttccagctgcgttgacgtcaacgacctttgctatacacgaatatacgcccattgttggaaaggaaggagctctcactttacccggatcatttgacaaaaacaatgaaattctgcaaaagaatgagaggctaaatgcgtacgatgcgtctttagaagcggttgacaaaaccgtaacacgcatgtttattgacttcaaggctattgaaccgatgagaatcgagacatacaattcgggcacatcactcgtttacgctaagcgacctaatgcagatcaatacattaatctacgtgaaattataatttcagcgaaatacatcgacagtgacaaattgagtatcgaagcaattaaaaacttggcatatgttcatatgcgccgcagacctcaggagttcgataacgtagaggtgttaggtgtgtacattgacgatattaagacatcattcaagttcgttgaacatactggactcagcgatattgttgcagccgccccaagcattacaatcgaccgcagctcccgcaacttggatactgattttgaagttagtgaaatctcagtctattatcatcgcatcactgatcgccaaggagcgctttccgatcccgcattaatgcgtgagcttgaatacttatctggattcatgacgcacgttagtattgatgcggatgacatccagaaatgcctagttaactttaatcattccgatccaatgaacccctccatttataaactcgaccttgatggtacgaggatagatgaggacagccttgctgatgttaaaattagagatgggcgtggaattacctatgctggacgtctgactctgtcaacccgagactctgaaacacttacgattactgatacactcagcccgcgtgaggtactagggcaacagggtattcggaacatctaaaattctaaacggaaccaatatgaaacatc

SEQ ID NO: 345 - DNA, 1575 bp, Unknown
  derived from dsRNAs of unknown virus
gaatattgtaatgctgtctattcaataacatgaatacgctatcctacgcaaagtacagtgatggtgttaaaacgcatgttaatgcaaagaaattatttaaaacaagacaacgttcaattctaggtgcatttgttgttgcgtcatcaaagacgacaatcgacccaaatgcattattgatgcgaaaggataactctcgaatattcaatgttgatgaagcggatgtactgctaatgcagtcaacacgtggatacacacgagataaagttatagcgtactacgaggctgtgactcaaataccgcaagcatctaaaaacttagccgcgtacacgaatttgaaacatgatccccctggcacaatagagccacgcgaaatgacgaagttaccgaagataatttggtacgcgaactcatggaccggtaattcttgggtgcaacatttagtgaaaagtgacggtggcgtaccctgtttttggacgaaggatcatactgaaatatccgatccatttagtaaagcgtggagaatttacgatacaaaattcccgatgagaggatggagaataacgtatgacgtacacaaaacaaaagatcatgtcttcgagcaactgcttaagtttttggagaaatatgctgatgaacctgtagtccacgtgtggatacaaggtacattaaaggatcgtaacccgaagcaaaccgttgacgatctaagagatatggttacttctgaatcagcgtcatacgctgatggtgaagtgtcgaataacatgattccacgcggtacacaaaagactgctgaatacatgtcactttgggaaacaccactatcggagacgcaagatttatgggaggcttatggaggacgtgccccaatgcgtattccaataatcccgtggcgcgtctcaaatctaggtccgagagcttttcataaaggaattcctccgcagctttttccatcttcaactattaaaacagttatgggaatggataagagtgatttacattttactgaagtatattgtaactatagctcttttgtggagatgactcagctaacggaggatgatgtgaaactacttgactacggatggatgccagttggagcgaatctgttcacaatggccccaattacgaaagataattacactcaccttcttaaggtgaaggacccggacttctttagagggtgcggatcagttgtgacatcttcgcacgcgtgtttcggactcggtagaactaacgatgagttattatttcaacatgaacgaaaagtccaaacaggtcatggaacatcaggacatatgattgccagtgtactggcttttcaaagtcaattcctatggtacctacaagaagtatttgataattacactagcaataaaagcgtttacatagccaaattcagagaaccggaatctggcgtgtatcacacgatacatgagtacaggaatgccattcatgatatgaaacggattgatagtaacaagatatatccaaaatatgctagaaacaattttgagatatgcaaaaagttcgttaatctgctaaaagtttagtagggaacagcggtgcatgaacatc

SEQ ID NO: 346 - DNA, 1743 bp, Unknown
  derived from dsRNAs of unknown virus
gtaaataaaacctttatatatttatatataacaatcttatttcaaattatttaattatattatttttaattatggaaatattaagtctttcgccagaatcactggataagcagctaactccgttagctcagacacaggctgccgctggattccaaatgttgcgtgaaggtaaagcacctactgcgcgtactcctctttacaaggatagcagtgaagaagaagtattcgctagttggctcgatatcttgacccgatatgaagaggatgatgtattaaagcctctgatcacttatgataaatcgagaatgcccaaggttggacctcaaggtggttatccgccattctcggagcgaactagtgatttcgaagaatattacacacttccagatcaagaagaatttgcaatcgactatgatctatgtgctgaaatatacttagaggtgtttggaggggctaaggacaaaagaccactgtctccacaaaacgtcgtagatcgcgatcagtacgacgacaagctccagaccaactcaggaccacctgattatggcaaacgcaaggatcctgaaattcttgctaaagcagtagccgacgcaatcagcggcaaatggaaagagttttgtatgattctaggtagtcgttcacaacgaggtaagtttcgcttcatctttatggcaccattcagtctgaatatagttgagaaaacgtttttgtaccccctaatggatattattcgtgagattaataatccattcttctcagcatgggaaggttttagtgaagtcgaactaggtttcgctcgccagaaattcttcgagggagcgtttttcattcagcaagactataaatctatggataagtctctcaaccaaacaacaattaagatctttcttgccatagtgcttccagtttttcaaaaacaacatcaagaaagtcttactgagttagtttatcatatcttcaacatcccaattatggtcagccttggcaaattggttgttggaatgcacggaatgcccagcggatctggattcactaatttcttcgagtccattatttcctactacgtgtggaaattaaatgataaagacggaggactcactatccctcgcgcccaaggattaggagacgatttggcattctcagtacaagcacccggggattggaaggaatataatgaaagcgatatgttcgacctctggcttgaaacagccatggagtatgcacccgatgtaatatccgagaaaagtgcctcaataggtttaatagtccaacctgaaaaacaactgatcgacagatacacgacaatttacttacagcgattctttgatgtacggattccaaacccgaagaatgatctcgtcttaggtatgtaccccagtatattggcattgaatactgcgatgaacccggagaggtttcacgaccctcgaaaatggagtagcaagatggagatactccgatggattatgatcttagagaactgcaaaaacctgccgtactttgaagacttagttcaattctttatagaaggggacaagttcaaattaggacttgctgacccagaattctttataatgttaccgtcaatttatgaagattcaaaactaattaaaggtttcttacctacttataatcaagaaggcatcgatagaggtatcaatgactttgagacagttaagtatttaaagagattggccagccaagcctaaacgtttgcaccaagatctccatcttggtgttttt

SEQ ID NO: 347 - DNA, 1415 bp, Unknown
  derived from dsRNAs of unknown virus
gaatattttgagaaaccttgagttttaaaattataaataagtgcacatctacatataaggtaaaatgactgatttatcagatataatgagccaaatggctatggaaacaccgactcaagcagttgatgaacgtagcgatggaagattcgctgaaatgatgtttgtcgacgataagcttagaagtgattacaaagccctattcatggcgtctgataacattaaacgatgtgtgtcaaaccctaacgataactcgctttcacttgatgatagagctttactaagcataatcggacaggtggagttaagcgagttggagaaggatctggtcccggccgaatccgaaatccttgataagattgagaaggggacggaggattatatcaaaagcgcaacatcattggagaaacatcgtgaaaggtatgccctgcttgagagcatgtcgttcgacaagaatactaagcttgcctcaaccgaagatagaaacgaagttagagccatttactcagatatcgaagacattagggaggaaatgttctctattgaatcaaaggtgagaaacatcactgccaatatccctgtcatgcaggcaaacgttattggacttgagagagacctgaagagcatcagaagtgagggttttaaactgtcttctaaccccagaagactgttgtttaaacatgtcggaggtgatgtgtccgctaagtattctaacatgtctttagctgacaagcttggaatcaaaaagttacttcaagaaaaggtcatatcctcgctaaacaacctagtgagcggaccaggtctggaagatggaggtgaaattgggctatttccttcacatggatctctaatcggcagtagtttcgataagagtttttccgatttcaagaaaacctcatcagcaaggatactgcaacaagtgtatgaaatggctgtggatcttgagcgacttagaacgaataaccttcccatgcgggaggtaccggaagatgttagcgtttacgaccttacgaatgattcaatcgttgttacgtcaaattccttacagagagagatgcacttattaaatttaatttctctcgctggctacagccccgagctctgggcacaagcatttggagtaccgattagtggaatcggaaaacaaatcttgggagcatggggatctgggcacgctggacctctaaaagccgaagacttacgaagactgtttaaaagcgacactaaacgcatctcatacgatttagattatactacactgattgattcatttaaaattgatgaagttagaaccgttagaaaattaacgactcctgcgaaggaagcggatatcaatctggatgctactgaagagcttgaacaaattgctgaagtatttggagcttgagaatgaccagtgaactctcaaatgaaacatc

SEQ ID NO: 348 - DNA, 1700 bp, Unknown
  derived from dsRNAs of unknown virus
gataaaatatatctaatttagttttaactatttagatgttcgtcaaattaatcaattgacgtgtgtccgcgcacttttattcgcgtatctttcaactttggcggctagtaagaagttaggaaagagaggtcatttctgaccaaaaatccacgtacttatagacccctatgaaacagatcctttcatatgcaagagacaatgtcctgaaccctaccggtgatggctttcctactgttctttttgtagtcagaaaagtttccgtcttttctgagggtagtgctgtcgctacccaaatgggcgaagctgttaatagagttcgctatgcgttcctcaacaacagttttcgtaactcatatgagattcaagaagccattgaacttcttgatcatctcccagttatgcttggtaaatcgttagctattgctcatcagcgtgagttaatgaataacgttagttaccttgactctctggtgaactccgatgagcttaacttctcagagcagaatgctttgagggtttatggaaccgtttccaattcggcttccatcacgtttgataacgcgattcgtgactattgtcttcctgcatttcttatcgatttgcttttagtcacggctaccgttatcaaaagtgatgggtgtggagaaaccgctttcgttattcctttaatgacgaatcccatcgatgatggtatgatgcgggcgttctccgacaatcgtttctgttttacaagtcggctgattaccgattttatagacagtgttacgttgtcggcgcccgagaagcgtctctccatgctgcttcaggagcatctcgattggacacagctccaaggcgttgggacaccacctaatgtggacagtccctctaatgtcagcgcgctgctgaatagcgccatttcttttaaccacggctttccgaatcttaatcttgagactgccaattccgtagtcaccaaagggaagttacttatgagaacttccgctaggttagacgttgacgatagcttttctttccttgtcaatacttatattgattcgagaaagataagacaaggtttagactcttttaaagaagagattattcctgtttccgattcagaaactaggtttaagtggacaatccttgctggtgtccgcttcggtggtcgtgaaaaagaaattttctataaaacttatgtgtatcctggcatctgccagtcctctacatataagtcctcccgttatttccatgttgacatgggattaacaggagcgaacacattcaactctggaatcaccccaaggttgaagggcgttcgctccctgaatagtttgttgaaagacaaatttggtcagcatattcagttggagacacccaactcaaacgtcaatcttcacagaatggcgacaacgttccaagcaagtgtcgacgttgaggatcattttaatgattctttgaaggacctcgccaacatacttctgccaaggaattttggtcagaaggcttacgccggagctccttcggttaaagcacctgataacgaagattcctctattaaagaggctgacgcgttaccttaaagggtctaagattggagaattttagacttgctgcgcggcgcagtgaactgtggctatgtaagacaagtacataggttctaggtgaaaagtagatctgtagaacaatcagtggagtggatatcgcaaacccactcaccc

SEQ ID NO: 349 - DNA, 2809 bp, Unknown
  derived from dsRNAs of unknown virus
aaatttgagttttatttatcactattaacacgtgtcttcttgctatggtcctctatataattttttaagagtttctatatagatttttacgtccttgtgagtcgtctagctcgttaactagggctttaggtgcagccacctctttgaggttcttttttatatatactaataaatctattgattggagcggtccgattgcctttatttggattgcaggaaactttgcttttgctgttagagcacatgttctacttgtcattaataggtatcttatctatcgtgactggaaagacggttggaatgtttgtaaagaatatcttctttctacattcattattctaacttatctagcaccgctgtattctgaatatattgtcttcaatttctgattaatcattatgggaattgaaacagttatcattggtacagttattgccactgctaaacttgcgaaaggagcagctattgcttcgaaaagagctggatataaagtttgtggcaggaaaagtactgctctcctacgtgaaggatgtaggaaaaaacttacgcatgatctcgcaactggccatgcgcatgtaattacacaagaagccagaggcaaagtccatgaagttggtcaacagcttgtaactggacataccccaattggtcaaggccttgagggaattaatggtacgcctcagcatttgcttggtccgaaagggattactaatactgaacttttccactttgcggaaaatgttgagaagatccatattgtagatcatgatgttgggtggtgggaaatgattatacatctttttgatgcagcatctgaactacctcttgacgtgatgttcttattatctaactttaccgacatcagtcatcttattttcgcacaaatctatggtatatattaagcacttccatggcacgcttggaaacaatgttaaacagattaaacttactccaaaggagcgtggaatcatattttctcgatatggtaataagctgtttcatcgtttcaatgaaggtatatatcgatctctacttcttcttcgtgcagataaggaggatagtaataacgagggtacaacagctcgacaatcggctgatggtctttacgataaggatacaggaggcggaaagcttgataactccgctcttaatattcgtaagccacttaacaaagataagaagccgaagaaaatgaaaacccctccaatggatcctcctcctgcacaaggtgctgagagtatagactctcagatacggtactttactgatcagctaatcggttttcccgttaatgctaatactattaatgggtataagcgtcccagaagaattaactctacaatttatattcgtttcctaacagatacggactctctcatttctcagagcttccgtcgcgttgtagttgaacgtatttggaattctactcgaagcaaacttcttaagaaaaatagtggtttgacgaaattttttgctagtttggattttctagaatttttctggagatccgcattcaacaatacgtttaacgtacttgttgttatcctgataaacgaaagacgtattagctgttcgtctaagctgtctgagatcaaaacatatgatacacgtttggattttatccgtgggcgtactatcggacgtgtagctattaatagtcgcgttagtcgacgaattgactttctcaagtcttttgtaagacagctagcccttccgccaaccctcgtggactatgctattgaacttgccactacttatgcttgcaaagttggacaagttgaaggttttctggatcaaagtagttttaatataaagttcattaatattgatggcgatggtaagccaaaatttgaagaggtgactttctacacaccagaattcatgaatgaaaatggcttcactaaagaatgggatgatactatgggtatcctttataacattgcccaaaacaatgtaattcttgaactctttattgaagagtgtagtcaatgcttcaatggctgggaattgactgacgtcttcggtaaatttgaaagaaaatgtggccactatgatgttagatgtagcccatttagctgccaaaaacttttgcggcagaattcttttatcggatactccgttagatccgatagagaggaagattaccggaagaagctttgtgattttggtcacgtcattccctttcgagttactgtagcggataatcaaacaaaaaacatttcctttaaggaacttctattctcggatgtcaccttcaatgatgaagtcaaagctactggacttatttataaatatataagaggtcgctttccaggagccttttactataagtctacaaataatattaagggagaaaatcatgtttctctttttaatctcgatattgcaagagaaatttgtagtgatggcttcgtcagaaacaaccaacgagatagactttatgatgagtattatgaccgatctgtttatgagagtatagggttttgtagtcctggaaaaggctatagctacttccaccctactctaggatgggtctttgctgacttgacaaggttggagagtttggttgacaactctcttgcagatatctttgaatgtaacaaggagaagaactggattgaggatgtgaagcgcattattgttgctgatgatggaaataggagctttagttttaattaaagtttatcagtattcatcgcttttcacttcctaaatggttgaagatgtcttattatattacactactgaatttatattcttctacacgtgcttgaagcagtagttttattttaagatatgcacgtggctt

SEQ ID NO: 350 - DNA, 1919 bp, Unknown
  derived from dsRNAs of unknown virus
gtgaattatgatcacaactttttgaattagtcattcaaaataagccaaaaacatatatttaataataacttactatatgaaatattcgcgtaaaacaacacgaatggcagcttttctgcctggagcaggaggcttcgccagtaagatcgcaggttctgcaattcgtaagaccgctgcggcttacggccaaggagcagatcctagaacagcagcagagattggtacaacgggcgcagtgttcgaaaacttaccgcctggcatgaaaccgttcctagatgtccctggcaaccaaatctcgaactctgggaaaccagatccaaataatgaacctaaggaggaaactagcatgaagaagggcaatggaaacggcaacagaaaaaccactacaggcacaacccctccaccaagtggcggcgggaacaatcgaaacagacgacgtcgaagaggagacgacgactacacccctagtacaacgggaagttcgattaaatcctatggtgctggctatggcattacagatagcggttctttagtcaatgagcaatactcgaagtttggtggcgctttttacaatccattgtatgtacaggacgtcgaggaagatcgaggtccactaaatcagaataccgtccgaacggcaatccgagtgattagttgttatcccacaaatttgttacaaacagatttgccaacagatgatccatttagaactacatttcttaattctaactccgaattgatttccagtatagaacgaatttatgcagaagtcaagatgcaggttaattccaacatcggcggtggaacagctgcatcaaagaacagccttacatttaacaaatacttagagtttatccgcttaggtatgtcagggttagccctgctttgtcaaattaatgcaatccagtcttgggatccagactacctggaatcgaatcttgttatccgcgagatgaaggaccaagctgcaaatagtatcaatctgtacgcggctagaaatagattaatgaacaagttagtctacttaagcttgcctccaaaagtaattaattactatttggaattattccaattctataagaaaacacccgtggaaggtggtggacatcagttccatatcttggaatctatagcaatcgatttgagctcaacaacagatacggattttgccactatcattagtgaagtaaattctatttgtgccgcaatcgacgcgactcccggtttagacgatctagctaccatctcagcattacttgttgagaaagcagattaccagtttatcaatcttcgtcgagttcaaggtatgtacaacaaaccttgtttcaatcctcgaatgaatggagttctagacaactgtccaacttctactgaatcgaagaagaaacttggagaaacaattgttacgaacggtggtttagcattcacggaagacgcaatctgcgcctatccgatggacccggaaaatgtctcaatttatgaagcagcgcatacattaccgttgtgggatcaagtgcagtataactctgaaacaggtgcgttctcgcataacaaaactgcctttccattcttccaatacgtctatgagttgacaggaagtgtacaacacaacaacacaggatacttagccgtatcaactaaattaggggatgtacttaaaccctatgggctaggttttactatcatttccgatcctcaaactcacattacaaaccacatcaccagtgtctctacacttctacttaacggagaagttaactcgttggcagtgccaaaaggtgataataactacttatacaatttctcgcacagaaatgttcttaatgcgaacgtgcgtttaatttatgatctatttggtgtacaaatcttctagatcaggataataataccttcgggtaggatgggtgtaaacccatctc

SEQ ID NO: 351 - DNA, 1362 bp, Unknown
  derived from dsRNAs of unknown virus
gaatattacacgcaatagtaaatattgaagtgtgaggcctataaatttatgtttgttttatattttccacatagaggagagaaagttgtagtctccggtgtgccgcttgatttatctttgtatctgcttagatacatatccaaagtagctgacggggtgttgcctgatcagattggaccggtaggaaaatatcctggcgcgacaaccccactcagtcattggattaaaactaccgttaagcgcgagctgtatagcgttcttaggaatattacagctggcgctgcggtgcttgatcctgcatttattgctagtcttaacgaacgatatattcaagcaatcttggaagacattaggattggatatatataccaggatactaaacctggtttgtcctaccaatctactagtgctcataatctcttttcgaacagccaaactaacattgttggtgatacggatattttacacaaattagtacgcttttcagttggtgcgcataaggacgggccaaatttgtttgaatttcttagagtgtccatcgacagtgagttaagaaataccgctgggatacatccaatttcacaaaaggctctaacaagagaagcgaggaaaatactcgataagtacacaacctttcctttctaaatatggatggccataattgggctgcatttgaggaaactcttacgagaatcaaacatagttgctatgctatgcacgcgttgtatagaaggaggtacctgatttctcgagaacgaatggtatactatgatgttcccattatcgtactatcagctatcactagtgtttttattgctggcgctgaagcgtggcttgggaaatcggttgtgcagattgttacatgcgtaatgtcactaacagtcggtatacttggagcacttaagaaattctttaaaattgatgaaaatcgcgagagctgcttagaaacgtacaaggatatgtttcgattgttctgtgagctttcaatgatgcttgaccaaccacccgcctcacgcggtgttgatcctcaaaaatactctactgagttgtcgaatagatattcggaggtaatggatcgcgccattgtccttgaggataataggacgctagaaaacccaatctataatgataggaagccgttggatcctaccatacgaaagaagttctctagatcgtttactaaactacctcccgttccaaattcatcacgcgaaagttctctaactatcgatgatattgaagaacaatattaaacaacatgagttttagacctaatacttacattattaatgtcgataataatgaattgctgccatcatggtcgaaatactatgatggacatgtttgcgtgtatgaaacatc

SEQ ID NO: 352 - DNA, 1754 bp, Unknown
  derived from dsRNAs of unknown virus
gaaaataatatttattaatcatttctaatttatattatggctaacccttttctaatagctttaatcaacaggttagcactctaacgagataagttgaataagccgagttcagacttttaagaggtcgaattgtatctattttaacatcaatcaaaacatggcaactggacagcaatactcacctgtaagaaagaattattcgagcgacccttcgcgcacaccaagggtggaccaatactgcagattattgatcccaatacgtagtgtttccatttactctcttggttctgcgtcctcgattaaacacatggttgccaaggctaacttatgtcgtcttctcacagatgaatttagaactgacggtgaaagaaacgatgccttagaacttatcgatgactgtttggagtcgcttgtcgttaaaagtattgcatcgctttctgaatcaactaactggagtaatgttcgaaagctaaactccttagttaccaacggatcgccccttcagagtatcgaaaaggctgcatttcgagacgttggctttccaacgaaggtcagcatgacgaagatcaatgatcttctctctgattgctgcttaccgcagcagatgatccaggccgttcaggcgtgtggcagcgtcgttgaaggacctggtggggatggacgcgatgtcgcgattattcctcttattcatcagttaattgatgaatctttagttaacactgtccttaaaggccaatacgcttttagggctcgtaatgtcaatgatcgcttggctagttttagacttgaccaacgtgaattgcaactaaaagacctccttgtagataaggccggttggcaacaactacctgtctatgcggaagagcctaacgtattatcttttgagtctgttgacgcaaatttatcttgtagtatagccttctgcaatgatattttagacaacagtttgtgtattaaccctgcacacgttcgtggaaagattcaaacttttaagggaaatacagaatttgatactgatgttacaaattgttattcagaggctacctacacctcttttgaggatgtaagtgatcctaatgatatcattctccttgagtctttcaagcctggtgaggacgaaaagggaagaaagattttgtcacttacattcgagactatgacttctgaagaatgctctgagaaattgcattctgattttgaggacgatagaactttcgttctatttcctggttggatttcctctagtgctcacagaggtagcagattttactatgtaaatacagatccagaaaaaggtacgttacctaaggacaccattcaaggtgcagctactttgacgaatgatattcattctcgtttcagaattggaattaattatgctcctcttcctgatcgttccggaaattattattctggatctttctatcaaggaacttatccaactgaaactgtagctgctgaaatgattgatttcctaacatttatgtatacacctgagagactctcgggtgtatcgagcacgaacgaaagtctaaattctatggactttaaatcttctagaaagaagaagaatcagaagaagcaattaggaactgtttctgaagaagatgcttcattcgatggagaaatagaataacagaagaacaaaagggattatatataaagataatatataactaaatgaactaagaaaatcaggcacctaccatagaggtgagactccggtcgctgagccagcatacaaagcgggcccc

SEQ ID NO: 353 - DNA, 1674 bp, Unknown
  derived from dsRNAs of unknown virus
gtaaaataaatgaaataaaactgacgtaattatagatatcttacctatgcgtggacagaaatcgtcaaactttgtatcgggatattcttctcgaccttatgtcgcacccatgttcttcaaaattacattacacatgaaacaaccaatccgccaagttctttccgaacttaatgcatctgttgatgctattcgtagccttgcccgattactagagagaacaaaggatggtagtgatgagatttacctttctccaatcggtaaagcccatggcccggaaactattctcagtggttgggataggatctttaataataatcttggtagcatgaatgatgttctacttagtttagaagaatcaaatcgttccaaatacggacctaggtctatcgcagccccatggtcggaacgtgcttctggtatagaaaattccttttcagctgatcaaggaaggaagattgaatccttcttaccagatagcggtaggttacgacctatcagcgaagataatgctgccgaatacattaagttacaaacgtcagcgggactcccaactatgctaaagaaaggaaatgtccttatggaaacacttaatacacaatggagccgctactcaacaaccgatggagagtggtacataccagctgttccttttactcgaactcaggaaaataggaaaactcgtcttgtttggggctaccctctagtatacgttctagatgagatgactttctacagacccatccttgaggtacagtcacagaaaccttggagagcagcgcttcgtaatgctgatgacatcgactcagcgatcactgaactcatcaactacgctcgtagtcgtggaaaagttcttctaagtattgacttttccaattatgacaacactgttaaggagactttacagagttatgcttttaatgattactttaagagtttatttcagccaaaatatagaacccggttgctggaagactcggaaagatttaatagaatacctattataacgcctgatggcatactttctggtaaacatggcattccatctggttcagcttacacgaatgaggttggatcagtggtgcagtacggtatctcacaaacttttgatgagaacctcgagatatttcaaatccagggcgacgacggagcttacgctaccttcgatcccgaaggtcttaaagaccatttccgttcatatggacttgaagtcaatgatgaaaagtcttacatatcagatgattatattgtttatctgcaaaacctttatcatactgactatattaaagacggtttaattcgtggaatttatcctttgtaccgagctttactgaggattgtctaccaagagagattcaatgacttttctgaggatgatattagtggtaaagattactatgcgatacgtactctttcgatacttgaaaattgtaaagcgcatcctttatttaaagaatttgtcgagtatattgttggactagataagtacaacttagactttagcgaccaaggcctttcatcatatattaagatgcgtgaaaagcaagatggtagagacgttaggttcacggagtacaagagaggagacgggtttggtattaaatctttcgaatcttataaacttgctagagaacttattgtttaattaatttcggtgtaacacttctgtgctacatc

SEQ ID NO: 354 - DNA, 1780 bp, Unknown
  derived from dsRNAs of unknown virus
gaataaaaagacaaggtatatctacatattgaattatttcttccgcattttccacaacttttatggcccagacatacacacaaggatctactgtctatgtagttcatggtggtcagttagtcggtaccaccgtcctctatcgcaaaaacgaacccgtcagtcctgggaataatacgtatcatgtgtccggctctacttccaaaggtggtattgctagaaatatcaccggtgagatccacgagagtttcctcctctccgattttgagtacagccgtatgtcacaagatgagcgtgaggattatgtacgccgagtgacactcgctatggcctctcctccacctcgtcctccaccctctcaaggtggtggcggtctgagatcggagctcgactttactgctgatgagtttaaggattctcaggacatatcgcttatgcccgtgtctaataatctggatcctcaatcgaatacagttgatgacgcggtccctcctgccaatggaccattccctcttctgttgattcccgcacttggaggtggagcccgtcaatccgttattagtgttggtgatcgcacgcttgtagccaaccgccagcccgctattaacatgcggcctggcatacaacaacaacttccgccgcctccacctccaaagattggtatcagcactggggggggtgggccctcaaaccccgattcatcatccccttctctgagcggtcccgctggcaatagttcccttctaaacgcattcaatcttattagatcgcgtaccagcccaggtgacgctgatccattttcccgagtacgcgccaatgccacttgtgtgtctatgcgccgtttcttctataattactcgatcaccgttcctattattcgtgatgggcttctcagacgattaagtgacgcagagttacagctcgatgactctcgccctagtgccgaagcagatgccaaccttagggatctacagtcacaaattgtcgcccacgatgccaaagttgcccgtcggcgagaattggaccagattctctcccatgtcaccgtgatgcctaacaatgcctctacttccaacctactttctgaacaggagtacgttcagcttgtggctacgttcgatcaagtggcttcaaggaccgttggtacctcagtcccactcttattcgactatggtgtaagtaatgtaagtactacggtaaagcatattgaggatctattgtataactacactgggtaccttaccaacgcaaatgaactccgtcgtcgtggttctccataccatgaacgaacgccttaccctactcatcttttggatgcccacactgacggcccgtctcccgcctttaatgatgttctctttgctgaaaattgttttcgatatggtgtcaaccctattgttgttgctgatatgttcccacggtcgctttgcacgctggccgtacaacttatcgactctaggttgacaagagggactccaatcactctaggggaattgactagggctataaacatttctcctctcagacctgctgtgccgcccctgcatactgcctctactgttcaaggtgttcgggaagccatttctaatcttcctccaatgcctcaagcagtaattacagatctcgggacactgttgggtggacgagtaaacgacactggtatcgggccctccaagcctgccattgcccctagctcatccacggctgccgggattactgtaccccttccaattacctccccttagttgattaatctttactaactttgtcctttttaaaactc

SEQ ID NO: 355 - DNA, 3443 bp, Unknown
  derived from dsRNAs of unknown virus
gaatattattggtagaatttttaaaacagatgtcgcaaactccagagcaatataaaggaaaactcccacgaccatcaaaaactcaatctatacaagagtttgaagatgaagagatcaagccagatcccgagtacactgaatttaacagtgtagctgagatcttggctcgtcctgaatacttcaaacttatcatcgaacagcctgagttcctctccatgctaaagcgtgaaggcatgcctaatcctttggataagcagcctgacactatggaaaagaaagaagaacaaaagcaacctgatgagaaggaaaaagagtcaaagaaggtggaggaacctgaagaagcaaaagcgagcactgacgaagaggaaccaaaagcatcaattgatgtggtgatggtgccatcacttgaagaggtggcacccatgcctgaggacgcgatggatatggagccgaaagcggcttcactttttgagccgaaataccgtagagttaagcatgagctaactcagcctgtcgagattgatgtcactcatggactagccactctaagaaagagcggccttgatgacctaatggtgaaatatagtggtgataggcgtaccaagaagggatctaaaatgttcaagtggcttcaaggatttaggccaatgggcatcgtgaacccagtgaagtttgatgatgttacaggaatggtatcatctacgaatcattcgtttgtatttggtgaagacgtttctgggaagagtgcatcggcgcataagtatgaattaaacaggcttaggcccaaggtggttcaaagtactcgcggcgccgtcgacagcctacttcaagactactccctgcccgatgtcatcacgtcagcggatgagggtgctaacgaagtatttgacctgtcggttgaacctcgcccaaacgatgtcatgctaaaatctgcggatgtgatcttgaacccatggcgattacctttaatcgttcgcgatacgaaggctttccgtcacatgaccttgacgtttgatacttggcggcgtgagcatgcaccattcattaacgatatgatgctgcgatacattcgtcttcgtaatgcgaaagatcgagatgttgttacgacaactaccctcgctcgatcgatgtatgaccgtttcgtgttgagaggaatgggtggcaataacagtaacgattactattacaccgacatccctaatgatcgacactttcaactatgtgaaagcgtgctaaaccgttcgttagctagagccatggaggcaatgtccacccttacctcttcgcaacgttcgatcacgactaacatcacgaacagacaggcttcgcacatgttgctcggcctaacatccgtgcaacctagtgaggctgtgaacttcgcccgtcatttgggtgggttcttgcttggtgggcaaagaaggaaacttgaagtggatattgatgaaggaacgacgaagacgccattgatcaacgctttgtgcagcttcgcaactctgatcttagttgacaagagattcgttgacgataggagctacagacaactacttgtcaacgttcttcttccgttctatgacgaattctctattcaacgcaagaactcagttactaacagattggaaacgtcggaagacgtccacagcattgctgataagattacaagaggtgatatcaacttgcctaaggtcaccaaaatggtggatccttcaggccgtggtggcatcaaatctcgtgagattagggtgattctgacgaacctattgacgcggattgccgcgtctggatacgttcagactgagttggctagcaaaatgttcaagactcctgcggccgctcccttcctgccgttcacagctcgttctgacatcgttgacatcgtgctatttggtacgagaactgatggcgatgaatccagaatgcacgagttgagttcttacaaaccagaagcgctgagagccagcggactacttgaagagttctctgagcttctttcaaaattaagacagttcgatggaattggattggctatgtccgaggcaatgagagcgaaaacgcatgtttccaaatctatggcaattttcaatgatgcattcatccgtggttcgatgcataccgagctgctacccgctagtggtaggactgatgaatcgcgagctattgatactgtaacgctgccctttgatggcgcgttgtcattcttgctatacggtatcggatcctcagaagtggcggattcttctgatgcctacgttagatttaaggcgctgtcaatgactgctatgccatcattgtaccctgtgtacttgtacattgagcgtgccattacgcaaagtgcattcatcgaatttggtggtgatgaaaacttaatcatcactaatcgagatttggtgattgatgcgtgcctggatgcgttgagcgtctatttcgattccgtggatcctgattcacgtgatcgcatttcataccttttcgatgagagaactatgcttgagggtggcgctggctttgagctgcccaccctactaacgtccactttgcattcacttcacgattatcaacccatcgttggtaaggatggtcagcgatcattgcctggttcattcgacactaacgctgacatcgctgagaagaatgtatcgattaatgcttacgaagaggcagtgaatgtagttgacaaagtgataacagaaatgtacattgattttgatcctttagtgcctactaagattgaaacgtacaactctggaagtacacttgtctacaccggtacaccggtgaaggcggagtatttggaccttaaagatattatatctaacgcccaatacattgattccgataacctctcacttgacgttattaagaacctagctcgatcatacctccgacgtaacgctgaccaatttaggaacgcaacttttaagggtgtggtcatcaacaagattagaacatcgttcaagttcgttgagcacactggcctaagcgatattacagtcgcggcgcccactatcaccattgatagaagctcaaaatacctggatgctgactttgacgttggcgagatcagcgtttactatcatcgcctcactgaccgtcaaggatccctaagcgatgccgtaattgcctcagaattagagtatctcaatggatttatgacttacgtcagcgtccatcaagacatgattcaaaaacacctaattaacttcgaccactccaatcctatgaacccctccgtttataagttatctaacggcgcacgcgtgccagacgatgctattacggacgttaagattagagacggtagtggagttacctatgctgggagagtgacactgtccactagagagtctgaagaaataactattgttgataacctcaactctagggaagtcttcgggggaatggccctctaagtaatagaaatctaaacggaaccaatatgaaacatc

SEQ ID NO: 356 - DNA, 1880 bp, Unknown
  derived from dsRNAs of unknown virus
tggaaaatttcataataggtttatattatttatcataataagtttgtaaaaaataaaattattttaattaaattctatttatttacctcgttaatagagaactattattggtatttcttataccaagtactcataattttatttattgagttactaaccaattaaggtggtatacccttaacatgattgcactcaaatacaactgtatggacttaaatgatcagataaaaaatcttaatcgtaaaattcaaatggatcccgaaaacccaaaagctgaaagctggaaacagcaagttaaagggttaaaaaggaaaaatgaggttcagtcatcaggtactggttttggtaaacaaaaaccaaagttacctgaaaatcgacctgcacaacctccaaagcaggccagtcaaaatcctaaaaatggaaacgcggaactagatcagtcttcaacacctgttaaaagcgtgtcactattttcttttggacttgacaaagtaatagctggttttcaactagctattagacaaattaatcttgtggctggtaggcccgtcttcacggggtaccatacacaaagagtcacgcactatgtttatccgagttacgcatgggtaactcggattatcaagattttgcaattaacctttgtcggaacggaagccggccgagaatttgcaagggcgcttggaatatcgggttcgatagccaagcgtggcgacttaaacatgtatattgaaatagctgtaaagtaccagctgttaacaatataccaaatgttattcgatgttcagaacggaactaaaggtgcgttcagtctcgaagacatttatagggcatctggataccttaaggtattaccaggtacccgagcttttattgagatggtagcaacaggcgttgtaactaaacaggtagccaatggttatacagttcaattacaagtcgtgctaatcgacctcgagaaaactccctggaaagacgataagtactaccaggacttgaaaaagtctacagaaatgaatagggccgaatacagaggtatccacggcgcgttttacgcgtctactagggatatgtttgcatggaggtcttcagaagtttcgagtagttttaacccaccaccaatcgcagttggtgactgtactactttaggactagttagtgaagaaactgatttttcaagtaactctgagactatattcacagagagagaagatggtactgatcagaatcatattctgattaataacatgtcaataaactccttcacgcttggattgaatcagtatttcaatactcatacaagtgtagtcggagatattccggtcgagtacgtatatcaaccaaggattggatccttcggtgaggcatacactgcggttatttacgaagtctttaccggactcgaatcgacgctccctattgataataccaattggattggtccgccaggtaatcagggtggtccaggtaacccacctgaacctcgtgaccaaggtccaactggaaatggtgaatcacccgatccacctgatcagtacgtcgaaagggaactgttagaacaatttgacactcaggaatcatcaacagacttgagtaacgaattgtcagctatgctttataatgaagctagactagcaggaactggtgctgtccgaagtgcactgcgcgaagcagttcaacagggtggtagaattattctaaccattgctggaggtgcacttggtgcgcggatagggtcaagacgtgggataacaaatatcaaccaaaggtcgtttaatttgcatcccacaattcaatttggtccaaggtcaattagattgcccttctaaaccaatttgttaaaatcgcacctgggattcctatatattaggaatcccccc

SEQ ID NO: 357 - DNA, 3426 bp, Unknown
  derived from dsRNAs of unknown virus
gaataatttttgtgataacaaaatgacggataaaaagagtgacagtccagtatccaacggacccaagttagtgccaccacccatcaaagagggtcagaccaaagaagagtatgaagcgactctacctgaaggtttgactctgtcggatctgcagactaagccggaatatgaggagtttagaaattcagtagcttataaaaagctatttggagaagcgcctgaacctgctgctaaagaagacacgaaggaggaggttacaaaggagttgacaacggataaaggaacccccctaggtggaacagaggggtcgtcaacactcaccgttgcgaaagaggtcccccttgcacctgaggctgggcaatctgcagcagtaattgaaactgagggcagtgaagtagcaaccaccaaggccgtcttcacaaccgaatggcgttctgatctgcgaaggcagctagtatctcctgtgacaatagttgactatggaccacataagagagctgacaaccacgggtttgaagatctatttttagatccgccgagtagtattccaagtggtaagtttcgtcggagggctgagaacttcatggctcggcttacttttccatgtttggccgtagtcccagagacttctgaagatggttacgtagctatgggtagtcatgcccatttccctatcattggggctgcggcgttcaagcgcgctctacatgaagagtatattgaacgcgttggtgctgctgagattaatgcgagtaaccttcttcgaggcttgttgcataatgttccagagcacttgggaaagctaggggctagacctcctaacttgcctgacgcaatcacgcgtgagcttactcaagaaaaggacccacataaggtttttctcaactttggtcgtcaacctttgaatgcagcacagggcattaacatctgccccgtagttgtgaatcccttgcgcatctcgatcattcaagaggagaatagattgcaccttgagctatttaaggatcttaacggattcgttaactcttttgggaatcacttcaacgtcgctgagatggctcggattcgatttagacctgacatgacttttaagcgccaaaataattttgagctagaagaagtcctctatccactgcgccatcgtcgagacacgccggctttgattgagtcaatggtcaataaggcgaatggtggtggtctatgtgatgcatcaatggaagctgcctttgctgctatggcagatttaagtcctcgcgccatgcgcatgccccaatctctggggagatcaagtcccgatttgctagcttcttttatgcaagttacgggccctatgggcgtgaagtttgcgcaacaggttagtgcctattgtcttggtggtcagaatcgtaagattcgactctcgaccgcaagcgtctctctcgatgatgccctgttctttaggccattatcagctgcttcattgttgatcctcatggtcccacagatttttgacgaccctgacaagatttccatcatagtcgccgttctagagcccttttttggactcagtgatcgtgtagagggcggtgttcaagtcagcggtgcttataccctggctaaccaggtgctactgataggtgggggtccaaacccagcagggattagacttcctctaccaactggggtgatgcctgcaacaaccgcagtagctggtaggcctatgagaacgcgcattcgggataccctacaggcattcttgatcgggttcttcagtcgacagtggggcgtagagcatagccgagttggacattttagtgatccacgaggtaatcatgtcctacagccttggggagcaggcgcggcaagtgttgacggaattatatatggtactgaacttctatcatcagtgccattccgacagcaagctgaaggttgcgttacatccttgatcacatttgctagtatgctggccgctctatcaaaatcaatgggagctgagacgattctctttgaccacctgaaacgtggcatttacctttcagggagtttcgctgcttgtaggaagttaatggcagaaggtcttactaaccccgcactgttgcccgcaagacttggaccaatccctcgtggagcggttcacagggttttggaattagagtttggtggcgctttagcatttttgttgaatggtgcggttacgcaagatgaagcttctcacgggggtctagtccaagtgttccaacacactagtcgccaagatagcattccgatcccttctctgtacaacgagtacctagtcattgaacagggattggctaggatggtcatggccgatgctatggccaatgaaagcttcaagccggctgatttatacagacgtaagggtgagatgatcgacgtaattctgacgatcttggggaagtactttacaaatgttgactcagagtctaaggaaagactagagaccatgtttatgctcccagatgaatatcttctgcgagctgatggaaccagttatccttatccctacgacttaatgccttctatgatctcctcagcggcgcggccatttactggttaccaatcagatacacttaatgcagagcatcttgacgtggtgggtgaggaagctggtgcaacagcacggctatatgacctaaatccacgtcagactaagttgagtacctctatgttgaacatgaagcatggttacctagaaggccatgcttacattaaactagagaggatcactccaatcattgtccagtctctcgaaacgggtacctttgctgtctttacggaaaagcgcgcgccgccagacattgcgaccatcctgctcagcgatctaatgaaggttgaagaggccacacgttatgatatcagtgaacaacttacggttgagaccatcatgtcgctcgctgcgatccataacgccactcttccagctgcaaatcagaaatcttacattaaaattgatggggaacctccaactgcagacttctcaaagatctctcctcaagaagataagttcatgactatggaaagatttacagtcaagagagctcatgagatccacgaccacgagttcgaaccagttgacgtcaagctatactatcaacacttacgtgaagatgttggtcttgcgggagcgagggagacccccaatcagatgctccgcactcatatatttgtaccttatgaggcactcgcttcaaaacttgtgtcttatgagggtctcgacattcgtgatgcggccatctatgatgaattggacgttagggttacaacgggtgctggacttcctcttacatctattatcaccgtcggccgccgtgaaaaggaaagctatgagattcggacttcgctcgagtctaagaatctttactagttccagcctttaatggtgttgtctacggacgttatcaagtgaaacgaaaattttacatc

SEQ ID NO: 358 - DNA, 2044 bp, Unknown
  derived from dsRNAs of unknown virus
gaagaattgactctgtatttaagttctatattaatgatgtcattaacgaaagctcgtcaggccatgctccgcgatgcggagaaagagactcatgacaccaagtgtcttgcgaagacgcttatggacggcatcgtcagtcccatgaatacgaccatgaataatgaggtcattcctggtctgtcgaacggtgagcgtctcttgagtgtgaatggtagcgcatccattagtgtcgccgcggggaccaagagtgcgttggttgtgatggatgagacctcacttcgcgcgggtcagctagccgctttcgtcatcgaacgtacggcaacgcgtgcagtgaactacatctcgaagatcaacgttggtgaatcgagtgaattcctcgcttctggtgggatcatctcaagtgagctgtatggcaagaacacttctgggacggataacctgtctggcaccgtttgtggtggtcttctccctaacgtgacggcttcgatcatcaactttacgcactccgatctggctgcgcagacgcatgatactaactttgcttcggtcgactcgaagcagtctggtgtaagtgtgttgaacaccagcaacggcctcctgaacacttgtactctagggcccggtcttcgggttaagggtgttgagaatgtccggacgctaatcaacgttggtgtctctggtgatgctgaggatgtcggtggactcacttacgaggttgccatcgatacgaagaaaaacaccgtccttacctctgcttttggcgccggcgtcttcaacctagacttcgaggcttctcttcgcattcgcggtggcgatgagaccaacacagttggtgggcccatttattcgggtatgagcatgataatccagacatacgattggaatgacgaattgattgattcctttccccactcacagatctggtctgcggtcgatatcgccgcggatttccccatgttccacgttaacgtgaaggagagcgtcaccaactcaaagttcccgatttcgtctgtgaaggtgctccttcgcgacgtctcgcctgctggtgggcaagcgcatacgtcgatcggattgcagcaggacgtcaccatgtcggccagctttccgctgatgtacgagacgatgaaccggtctgtccttcttttcgagggtctgaatgataattcgaccctgagcgtgtcggcaggcgccctgatgcacgtcacgccacagcctgatcgctatggtgggctgatggggcgtcctatgctcaagaatactgttcatgcgagtgccatcttggattcaattgaggcactgatccagcatatgcctggtgcgttcagcgactcgtccaaggacgcgttcattaagcagttggcgttgtatgatgacgaagggactcttgagctagcgttctccatgcgctccttctcttcatttgcaaaggggttgcagcgctttggccgcgatgccatctccgcccgccatcttatcagcgacattgcgaagacggtccgtccaatgcttcaggaagcgactgcaatccccggcatcggtggtattgccggctccattgcaaaagggatttccacagcgcaagatctgggggtgctagaggctcggaccatctacaatgcttgactatgcactttcccgaccgttgtaaattccaatgaccttttgtcagtcggccacctgtatgcaatacgaccctcaagaacccacactctacatttaaaaagcatctcatcagagatgcgagtgttatgtaatctattacacattcaaggttttgatatatcgccaacgcccccgaacccaatttatggttcgtcatgggagatggctgcggttatgtcacttcttggtatgtatggaaactacactggagatgtgtgtggtgtggtaatccacgaggatgtcgttaatgttacgtttgggccgatactaggtctggacgtgaaagacgatctgggagcagtaatgacatctcacgatgtggaacaagtacgcatacgcatcatataatccccatgtggtgtaatagtgtcagtgaaaactc

SEQ ID NO: 359 - DNA, 2079 bp, Unknown
  derived from dsRNAs of unknown virus
gtaaaaattttattttcaaaacaaaatcccaaagaaatttatccaaaatttctaggtaactagtttaaattcataagctggtattacttaactagtacaaacaaactagcaaacatcacaattaaactgtggtataatgacaaacagtaacagacctgaattaactgacacttcaaataattcgaggaaaggaagaaaacaagctaagatagtgcaaaccgtccatagattagacaatggcgttgacacaagcttcgtaggtacacccttaccgagacgcggtttaccaggaaaagttgtagagaagcttcaaaaaccgggattccgatttgaagttggagattttgatcaaccaaatcaaagtcctaaaactcaatttgaacctcagatggagccaaggaatagaaaggatccaacggatactgatactaaaccgaaagagccagaaaaaccagttggagaaccaatcagagaagttccgaaaccagaagaattaaatgaaaacattatgaacaataataggtcatcaggagcatacgacaatagcggaagcagatcacgaagttctagaaatggaaacggtcgtggtcgatcaacatctcgtccatctggcaacgatagacaagctgttacacgtacagattcaactacgaatactgcttacggtactagttcgccgacaaacccaattttcttcacttccgcgagaagtaataattggttttcagacccaatacatccgcaaagattcagttccgcagagaatggatctaatagcgcgtttacaattattcgccctggttttcaaataaatgctgctccgcctacatctgaaccgtgggacaattactatattgaacaaccacaagttctgaacttcgatgatcagcaaagaatggaaggagcgtataaaagatatttctctgacataaaacaagaaataactattaatacaaatgcttccaatgctatccaacaagttatatggtacgacaactttattttacaccagcaacttggtatctcgttagtcgctacgttagctgagcttatggccagagaacagtggaacccggaatttgttgaatccaatttggttcaccgaggtatcaaaaacctagttactactaacattgaattgttacaggctagaaacagagcccaagatgcgttagctttaatggcagttccaactgaaattattgactactatcaatggctcttccaggtttacaagaaatctgatgtagtgggaggagttactcacacttttatgagtcctgaaatggccaaagatcttaattataatcaaaacttaactggtgcaacatttgacgctactataaagaagctaaattggctagataagcaaattaatatccattgcgaccgacaggcaaataagaactcagcaactccaggacttagatgtggcagcttcacacaaatgactgctttattattaaataaaactgagttcccattcactaacccgagacataaaattggttcttcttcaagtcctattttcaacagagaaatgaacgccgttattgataatttcgttgtttatacttctgaaactgaaaatggatcgagaacaacaagattatatccagcaggtaatacgccaacagtggcattgccttttgcacctgatgatgtaccctgccttgtaggtgcacatttattattaggtttcggtgctagctacactcagacagccggattcccatggtttacaccaggggttaattcgatgttacatggttggacatcaagctttatggctacaactagctctaatgcacccggtttcaatttcttatttgatttaagacgtggaagcgatcttcagataactaaccatttgtttaaatattcagatggtatttacgatgctgatggtcccgctgatggaatcttaattcctaaaggagacaacgttaaacgttaccaattaagtgacaacaatgctgtccttgactgtgttaaaatgttttacgaacaactaggagttaaatctggttactaattcgaataaatactctttgagggggggaagttggcaactaaccc

SEQ ID NO: 360 - DNA, 2536 bp, Unknown
  derived from dsRNAs of unknown virus
aagtgccagtcaaacaattttatacgtaaggcatagtgtgttttgaggtgccaaaatatagtgagtcccatggattcattggcccccagcacactactggtaccgataacaagcggcccgtccagagggcgatcgctcatcgtgttaccagagcctgaaatacaaattcgcgactcactactaaatgtatgtctgatattcgataactcagaaatacaaggaggtaatggcgttcaaaagcgagatcaaaagctaatggacatattactttcagccttaaattcttcagaattcgcaagcacgtacttcaatcaattagttgatgttgtacgaacgagaagattgcttagcggccttgacggagcgttgggtgacagagtaggcgtcctaacagtgtcgaattcaaatggaatatacgcagcggaaactattggagacagcttgccgctcacagatgcccgacgttttataattcgtgcacgccgaggtaacgataatgtggtaaacggagtaagaaacagtgaatcgatatcaattgagacagatatgaatgataagaagtttacttatttaacattaagcggtgctaggatgcctattgtggttgactcacaccaagatgcgctacagttacgtgatagtgataagctcggaacgatgaacgtcatatgtgacttctcaaaacatgttcatgaaaatgtgccatttcatgactatgatgttggtaaggacatggatcattctacatcagcaaaggactctggtgaatactacagcaagcggcctataaagatcaggatgtttaaaaactatggaaataaaacgggtctattgctagagtatgcaccacacgctgcaactcgcatgaaggattatgggtttggaaatggtgaaacattaatgttaaccgaacaagactttgacgccttaatatcaggaggacgttccgtacctgatgttaagatggaaagattcacaaccaaagacagaaaggctaagggcgtgtcaacgcgcttaaccctggaagtaccgggtgtacatgtgtcacacaatggtatcgactacgttgtgaccttaatacttggcgttttatcaagcgttatgcaccatgatgagataatcacggtcgaatcttttgtaaacttgaacaagaggttagagttaaaggagaatctcgtgaaattaatcactgtgatacctactgtcattggtagaaaccgcttcacaattaccgcaactggcgtaccagttataccatcgcatttggacttcggtgacattgaacatccggtaaatataattccaaacgcactaactagcgtcgagaataggaagcaggctgcggcagcgtacgcaagagtgctatcttctggtgatcaatggctcaacattcattcatcggaggttcgtaattactgttccgaatcgttacgacgctccttgttgcagcatcttgactcatcatcatatgcgcaaataaccaaagctggagtagaattcgaggatgttgagtatttacgagaacaccacaaaggcctgttcaacgagctcctgaagttaggttattacatcttcaaggtccaatggttacgcgatgtcagtattgaagagatttctgaattttggaatgaatattttagaaagcattcaaccccaagtattgtgcattcgggggaaattcgatcacccagtgaggtcctaaatggaacaaaacctatagacgctcctctgctactcgtaagagtcacactatccttactattaattgtcggtatgtcaaagaacatgaagaagcacaatcctacaaatattaatatgcgacctgatattcatcatctcctgagcgagaagcgagctaagctttcgcttataccattgtgcgtgctaaagagtaggcttttagcctatgaagtctcaggttcagttggacgtttgttgaataatgtcatagatggatcgttagaagaatcgatactcgcatctacgaaaagaaagagtagagttaaacttgatgacgaaagaatcgtgctgaatatggaggatgcagcttcatcgatgccattcgaaattaacgcaccagtaatcagagtaaatgatgctgaacgagcatcacgacgtggatttactgtgatcacgccatcaggagttgagctagacgtgtatccaatctgcgaaagtatgtgtgcgcgtttacgatcgtaccatcgtgcaatggaacgcgatcgtgttgcaatattttggcatccaattttctgcattattgcaagcgtaactttctataagccacatcccgatgtggaagcgataagttactaccgatgcataatcttgccttcaatgagaccatcaactatagctccttcgtaccataatactcgagatagtattcggttgagttactatggtgatgactccacaactcattatggcgtcttgaaagagatgataggttacatatctagttttgcgacgtatgcgagcatgtacttatgacccgactgttttagaatattggtccacacacttcagaaacatc

SEQ ID NO: 361 - DNA, 1128 bp, Unknown
  derived from dsRNAs of unknown virus
gaatatcaaacctctcgttcttacgactaatacaatgcttaatctctcttctgaatttaataatgctgaaactcgtcctaaggtaggctttggctttgccggagaaaccaactctcgtaaccccattgtcttcggtggtgttcaaccgcgcgattacggtcgtgctcgcgaatacagcccattggctgcttctgctcaagacgatactttcgcctctacccatttggtcccgcaactgcccctaatatcacctcctcgtggtgatgtggcgcactccatcctaatgcacggtggatttccctatttagatagtctcctcggctctactattactgagcatggtggtgtattaacgaagtacaagttccggctcactcctagtactgcgactggtcagttcgataattcccaaaagttcgcctgtgtcctccctctagatggtaatgctaattgccacttgattgggatgctcaacgctggcacctctggcaccagcagtatcgagtctaaacttgtcaacgatgacagtggcttcgacattgctcgccaggtgcttgatggtagtctcctcattgcagcctccatcaagtgtacctttgcgatggattcaacaaagagttcaggtactatttgtgctgggaccgctactttaaccgaccaacgactcattaataccgtgtccagtgtggatacagcttacggcgtctttaaccaagccgcctccatctccgagcccattgtcaatgggtcaggtggcgtccgatatactggttccgtgcgtagcactgaatctatcgttgtcaccagcggcatggcgttgtctattcctatcgatagggatctccactctctcaggactgacactaaaccgttggccagacgcgcactatgtatcacacttgaaggtcttcctgctggtgaaatcgctaattgccattttgaggtcagcatgattgttgccaaacacaaccagcttgaacaggcaggtaccagcctctccgacacccctaccatctgtatggcagacttatccagaattgtcattccgccactagtatctacacataagaacgagattttctaggtgtttatattacaaacatggttcactagaggtttcgaaaactc

SEQ ID NO: 362 - DNA, 1927 bp, Unknown
  derived from dsRNAs of unknown virus
gttttaaatataacaaatacgccgtgaggcattaagctcttatagagaatatttagttgaaatccatatctgacggaaaacagatcaaccgtcgtaaggacgaaaccaacaactaaagtaaccaaactaaacaaattattatggttaacaactggacaaataaacccttaacacaattagggtctggtatagaacaagtcggtagccgattaggtagtaccgcaggtgaatttatcactgggtcatcgttgcctggtgaaagtaacccaattttaaacccacttatgcaaatgggtaaaggtgtagcagccggtgcggcagagaacttgattaatcaaggagccgatcgtctgtctaacaagattaataatctaaacgataaaggtaaaatgaagaataaaaatagaagaaaaggcaatccgagatctaataatagatcaaagaacaactcgaaccaaagaaacggatctaataataacggatctggcggatttggaccgagatttaattctagtcatgatgggggaggaagtggaccatcgaaatatggctactctggtaaaagtagcgactcttcaaattatgctccatttaatttagggcccgtaggcgatcctaaacttgggggctacatgaaagtcggaacgccgtattgtaacaagttccactcgcaattgatagattcctcaacagcaactgacaacgcaaactatctgcgtaacgcgtttacattagtaaacctagattacctgcaactttttagcacctcagaaagagacaattatactacaagtccaattgacactgccctttacaaaattataaaccagtatagaatggcaattctttcgggcactggaggaagtaaggcagccgatgctatcacacaggacacaatgaccttatacttccaatatacccaatcgctaactgcgtacatgatagcgttaactgctatcattaattgggatccaccttatgcggaacagaactctgtttatcgacagttacagattctgttttctaacaatgtggagttacgtaagagaatggctgaagctcaagagttaatgcaccaatactgtcttccacgtggtgtaattgagtactacagacgattctttactgtaacaaaaataagtagcttagagggcggagtgcatcacatgtttattccagaggaatttatcagtgcacttctagccaatgacgatgacttaacagaagttgttaatactttaagcagcttagtaagtgatataaagacgaatagtttaacaggtacgaatgattttcctcgaattactaccttactgttagacaagactccgttcgacttcgtttcattaagaacagcgatccctatgccggatcatcctattcgggatataaaccagatcactcttattaacaatggagcctggaatgtaacacctagtgttatatcaactagtcaagatgacggaattttacgtggtaattacccgtatagctctagtgattctcgaatgatctcaataatggaaccagaagagatcgagacttacgaatatgcacccctaattggtgtattcgagaacgatcaaaatctgtttccaatgtggaactatagtaaagttttcacaacattgtccaaccgcatttacctacaagaaagtccatctacaccaactggattagaagtactaccaattcttttcgcatatgaagaccctcttgacttcatagcagtgacaagaactgtagaagtggatacgacaacaggcgtgcatactgtaagaacgtatagtacagccagaggtgagaacgttaggctatttgacctaacgattaatcctgttattgaagcgaacgttaatttgttgaatcaattatatgatgtaagacaagtttaacatagcgggggttattcgtcagaataactcct

SEQ ID NO: 363 - DNA, 3947 bp, Unknown
  derived from dsRNAs of unknown virus
gggggggggctcttgttttacaagagacaccggcgccactgttaagtggtagctttaaccggcgtatttttgcacgcaaagagcgtgcttatttgttgctgaccatcctatgttggtccctgatgagcggtatcgccttctggcggcgcacctcctgaaatcggaaccttaaaggtcgcgcggaggtatttatgtcgatatgtgacttggtaatctagcggttcaatgaccataattgaactctctttccctgttttccctcttttctcgcattcgtgcggtaacctgttagtcgatggacgaggtgccagattcatgccgtcgtgcgggacggatttgcacccatgacggcgttgatgtgtgtgctgaagaacaggatcctccagtagcacaaacaattgtccgagggcgcttcccagtagatcgcgacaatttcccttacgtggttcacgacgttgggttctacttgcgcggcgcgccacgacttggtcaattggctactgcagatgaagtagacgtcaaccctcatgtcattcggcgaattcgaccgcggctctccgtgtacgatttgctggggcacttcctggtgataccccagagcgggggaatgctaagacagtgcatggcggctttcgaatccgccatgcgtttaactttccctcacgctatggatcgagcatggacgcggtatgcagcaattttatcctgcgtctacgcgatcatgttgttcagttggaattgtgatgacggatatgtggtttgccctacctggtcccatcgctgcctggatcgtcccataatagcgatggactgtcaaggcttggttcaccaaataacgcattcgaactggtggcgtctcccgagggcaattcggctacttggtgaagaggagacacatgtagtggtgtgcccttggtgtaatcatccggctattctagacgaggatgacatcaattgcggcacatttcggtgtggggtggacgcacgagggcagccactgcccatccatgccaggccgagcataataagcgcgatgcgcgccggccttgaggacattctaccaggatgtgggcgtattttctttgtttccatcacaaacgatggggttgaagcgcggagaactgccgacccaagtgtttagtgttgtcgtaaagccgtcattttaaaattttttgaaaagacatgccaaggcatgcatggtaagtatgcgcgccccctgaaacaagaacctgaaaggtcgcgcgggggtttgatttcgattggagacgcagacacatcgtagttcgcaccctataagggtagtactcagcggcctagccgttctctttccctgtttccctctttcgcatcgtttgcaacgatgttcacttttatgaatcgttatcagcccgagggccaagtcttccgattgtcagaaaccaatccccagggctgggagactcgaatctggcagcatgaagatgacgcagtggtgtacacacatgattttcctctggaacttcgtcacgttgaaatggacttcgatggcagatcggtcacctcgtcgcaaccacgggtgatcatgttggatcctgaagcagaaacagcagctgactgggccatagagcatggcttcgatgtggaacgaccaggggccacagccgtgctacttgatcagtggggctggatgtttcgtgaccgccaagaagtggctagggcggtggcctgcatcaacacagattatcacgtcatactcattagcacagatgggaggtacaaaacgactatattcgctcccgatcaggatgcatcatgggtgggtgtcagtagcaaagggttcatgtgctggtttcagccttctccgaggaaaaatgcaaagcgacatgacgtcgccgttgacgattattccgatcaagaaattcggtctctcatggattggaacccttatggacgacccactgaagacgtagccatcgagccagtcgattatgacatgtcagaatgggtgggcatcgacgatgtggaagaacttcgtttactgttgtccgcggggcttcgctatctgcccagtgatcgcatcacccattcatcgagtcgagccgcttcggacaacgcaaatgaagacttgacagaactggcgagttctgatccaagccctccgccgccgacgccagatcacgacgtggttgagcgcgatagggctggacgcccaccgtgcgaaccccagcaggctgactggccaggaatcaatgttgccggcgacgcaattaatgctcgtgacataatggcgagtgaaaactgcgaacctctatcgccgtcaggtgtggcgttaaggttgcctcctggtttagaacctgtgtttgaccacagcgtcctgcactcgcagcattcgctaggcacgcgggatgcatcaacgcatgtcgatcccgcgacctctcctgtgctaggattggcctttgacgatgagcccgtgtccatcacgaatgcgacatttgagccgtcttcgagaatcgtggctgagtcgggagacctctccccatccagttgcgacccaagcgccacgacgcgtttggcacatgaaggggtcgccgttgaatcactgcccatgaatgaacctgaacggccattaggcaccattcctgaaggccacacgagtgaagcaccgatgtttgacgctcaggccgaactcgcactagcgctggctgaaaacagcgttccagctgatccttatgactcaaacgatggcatcatagagcccgtgacacggataccgacttctgaagttccggaaccgggccatggtgagccagcacctgttatacagatcacgtaccccgtcgccactccggcgaagaagctttgcatctcggagaaactttcatgtcgccaaaggtacaacgctcaatcacaacttgcggacaagcgtgtgcacctgtggggagctggaaaagtcccatccaagaacggcagggtgataattcagatccggcgtacatgccctttccgtgacatagacaatttctcaaaagctttgcctggagaggactgcaattcgtcactagggttggtggtgttgctcccagaacgcttgccttccttcccgcaaggcggtgtcggatcagtcagccctgcgcaggaattcggtctgatgttccggcatgtcccgttttggatgcggagtgaagtgggcaaagcctacgcagattgcgccttcgatgcgggtggtttaccaaagctcacggcagcgtttaatactgtgatgggctacgtaacgccaatactggacgaacaaacctcacgcgagtctgcacttggttggcatccagggcctatctcttcgccaggtattaaactgaccctagtaccaacgcatcgacgcggagcttatgctggtgatgcggcggtcaagaaaagggttcaggccgctctctctgcactatcaaccgataacgtacgcaatgtattggttttcaacgcttggcactctccacactatagcacctcacctgcattaggtgcagcgatcaaggccatcgaggccaaagggtggacgcgcccgtttcatcaagttgccgtccacgtgccagtagaggccgacgtggtgatcaattccaggcggatggcggagtcggctatgggatttgaaccatacgagtcacctgcacggccagttgtaaatataaccgatggcgacagtgaagccatcgtcaattactcagccatcaaggccgctcgaactcgcatccaagcagccgccacgacgaatacttgatttcaacaacccaatgatcaacgttcatgtggttatgcgtggtgctagagatacataggacattgatcagcctacgctacgatcaattccaagtcccagcttgtgtcctaaatctgggcagcgtcgtcattcctattaggtgggcgatcctgacagcgggtccgaacgtgaccgctataaaaataaaaaaaaaaaa

SEQ ID NO: 364 - DNA, 3486 bp, Unknown
  derived from dsRNAs of unknown virus
ggattttattaacctacttttaagtctttaagtaaagacgaccgggattacctacccctattggatctagcttcggtaaagaattataagagagctacccatttgaaacccttacctcagactaatcatggaagagaagaactctgaattacaaggttggaattacgttgaatcgtatgaattctttgatcatgtacgaccactgctatctgactcaagacttgagtatcaggattggttaaaagcaatcaaagcagatcgagataagcatcagggaactgatgtagtacatcagcttggattttcaggtctacctgttagaccctttactcctgttaacactcccaattcaatccctacattttctggccctttcacgtcagtaatgcctcggattaatgaacaacttgaagctacagctgacgaattagttaatgctggagctgaatttgttcaagctcaaatttctagagccggacaagcccttatgtcgcagttcggtcaacagattggaattgaagttggagccggtggtgatgggggtacaactaagggcgattatagtggaggttctaattataacaaacatggcttaagccttggagctcagccaatcaattcgtcgtttagaacgacaattgtacctcgttacagaccgttgtattctaacgacggtaatgataatgatgcccctctagtaatgttttacggagaggttttccccgaaattggagatggggggggtaactttgcaggtgacactaacttgcaacgcttcttgaatatagatgttataaatcagtggtcgactactttagccaggaaactgagacttaactcttacactagcactctaaatactaaagaatatatctttaatttcattagagttcagatgcattgtctttcgatttattatttctttgtgagcgttattgcgcacattaatgttactgaaaataggaatacaggaatgatcaagctttacgaagctctctctgccgaagatcttcaagagatcgcccgcttagaacttctgttaaagaagactccaattgatcctaggattaatcagtttgtgtttcacttgtacaataactacaagcagtctcacttaccaggagcccctctttataagatgatccctgtttccttcgttgatagcactggtttctccacttctagtttaaagtctggaagtgtagctgcagctatagacatgttgggttctagacggtataagcaattcgttgagggttacgttcaggctttccctgatgttgattcacaactgctaatgtatactggtgttcctaattttgacccagaccatctgactttcgtcagaaactttcctcatataggttatggttcgacggcttcatcagccactacacatctccctacagcagccaatcgtgatgagaagttaacttacaacttagacactgatgctccagacggctggacatttgcgtctagttcaatatgggttggctctaatgatcaatctggccttaagctgtcaggtggtttcggtggtccgaaaactttaggtagtactgatagtgatggttattaccaaaccgaactcttggttactaaccttgttcacactaacgcagttaaaactactactatagtgttttcggatgctggacaaagcgaaccggtgtttacatcgcctagtacacatgagacacagtctgatattgtttcacagacctataagatttgtagatcttataatgttgtgaacaattaccaaagacatggttgtcaaatagcaacacccgtttcagtctcggatatggaattgacttctgaggaatttgcgaacttcttgtttacgcctccaaatactactgtggctaccagaactcctagaagcgaacggccggataggcccaagaaaactaagaacattaagaaatagtacttgttatcgttacctaattgccaaacatcatttatgcaaactttcgacctccgagattttgaatcttctttcacaaccaacggatttgagaaactttccagaagtaatgccagaataatgaagggtagtaacttagttctgattactccagcagctgaaagagctggtcctactaatatctacgaagcttggctcaatgagttcgagtcttattctgaagcaatgaaccctgacttactggaactggaacgagagcaaatgagtaagtttacacctcgctcaattgctaaacccggtagtcagttaattcctggtgtttacgacagtttcgaacccgtcaagataaacacaagtgggcttagaccgttcagtaatccgaacgctaacctacgacctcgttctattgaacacagcgctcaggcaactagatctaatactcaagctgggtgtccaaccctagagaagaaaggcttagaaagggaaaatactgtgagacattttgcgtcgttgtactctcagaatcttacacagatttgtgcaattagaacgcaagaggatggcaagaccaggattgtttatatctatccttacgttgatataattcaagaaaatcgatacttccttcctctattttccgtccttagagagcagactgaattttctgcttttaaaggtcccgatgctgtagacttagctgttactaaattgctcctaaaggctaaggacaatccttcaatggtttgtgtctctggagacgtttctgggtttgatgactccgtcaagaaacaactgcaagaatctggatttgcagaaattaagtcttacttccaagctaattacattgacgagctggatgaaatcgctttgcgattcggcactaagccgcttgttttgcctaacgaacaagtgcttgtcggttggcacggtattcctagcggttctaactttactggaattctaggttctgttgtaaataggcaggtcctgaattcgactcctgacgattgtcaagtcatgggtgatgattttgtagtcattaccgataatcctgatgagattttcgctcggtacgaacaaaagaaattgaacattcaccccactaaaacgaaaattaaaccgtcgagctttgtatacttgcaaagattgcacagtcttgatttgactgtagacgggctggctaaaggggtctacccaacgtttagagcgttaactagacttgtgtaccctgaacgtcggtcggacttcgatgattatggtctcaagggtcgggattattttgcgatccgcagtctgacaattttggaaaactgcaagaaccatcctctgttcgagaagttcgttaagttctggctgtcatacgaaaagtacgtattacctagtaagagttcgatccctacatacgttagaatgatggagacgaaaagcgtggctctaggtacaactaaccaatacggtgatgctgtagaaggtattcaaaacttcgaaagcttcaaaattgctagaggtttagttggataaaagcttacaggcaggttctttactgcccc

SEQ ID NO: 365 - DNA, 2796 bp, Unknown
  derived from dsRNAs of unknown virus
agatttatgcaccttacgcgtatatcggtggtgtaaaagactaacaaagaatagggtagtacctatgagctacatacctgccgtgtcatttagattccaaccatggctacttcaaataggagattaattactatggaaccaatcaatttagactctaaaatctttagagcttggaatgattttaacaaggtatcaattaagaagattcctgatgctgctacttttcagaaattaatttcactctcaccaaaaattagaagttggtatcaagactggagctttaataattctgctttcagtcaaatgccttcttcttttaaggaacatggtgtgacacctgccaagtgggaggagattgcatctagacttcctgagataaatttagcacgtaaggaaagttcagcaaggattgaagttaaagctaaagagttttcagttatgattgaaaacgaacagatggctcttgctgaaaaacttgcaaaactggagaatgagtatgttaagatccttaaaattaatattacttgtttgcctattgaggatcaacttgaaatcctttccaagcctgaggaggatagggaaaacgttgaaaagataaaattagaagcacttagaacaaagcttctcaaagatttagcagatggagactttgtcgaccctttcatttttggggacttcaaggatcttctaagttaaaacatagtgaaaatgtccaaaagaaggcttatcgtttagcgaggctttggtatcgtgagaaggattcatggaagaaccaacgttatgttggctgtgagatggatgatgtttcaattggaaatattaatgctgaaagggaaaagacttgggaacgtagaaaaccattagctgaacttttcaatatgagaccagaagattacgatctttctggtgttgttaagaagattactaactacaaaccagttaacaataatggggttccttctattgagaaggaaactactttcttgaaaagaccctttaagcacgatagaccattaagctctagtgaaaggtctcaacttccactacctatcacttcatgttgtaagtgggttggtcttactgacttcccagttggaacatggatgcaaaacttcagacaaccttacggttggtttgatggtttgtctgattcaaaacacctaaatcctctgctaaaaggtaaggaggaaagacttctgtcaaggtacacccttgtctctggttcatggcaaacaaataagagtttgcttgttgatatgggaaaaccaccagctaacaaagataatgcttccgtttatgagctacttgattattctattgataggattgataagtttgggcttcctgttatttcttctaaactcccgaaatggtggttaagagcagtgactatgaatccagatgcaaatcctggagttttgacaaaacgtctatttggtgctaataagagggctgcttatggtaaagctattattgtggcaagtagaatttgggataagattgtaactagtagatctgctatatgtgataattctttgtggtctgttggtggaagagctagaaaacaagacatggcgaaaggaaaaccccctgagtctcgtattattttaatgcccgaaacacctaattcaattatagcatctgttattgctcagcctattattaaagagatgaagaaggtctcgactgcaaatcctgatgttgaatgttttatgggacatgatgtcactttaggtggatggagcagaattaaagagtttactaaggaaggaactcctacgttagaattagattgggaaaaatttgactcaactatcactgaaaacgttatagtcgcttctttttgtttactaagaactgtgtttcctgaaagccgaaagattgacaaattgtttttatttgtgatgtctggtttcgtgtataaaaatattgctatcaaacaaagatttatatacagaattacacgtggtgtgccatctggctcgcctttgacttcactaattgtaacattaagcaactgggtttgcctaaattacgttctgaggaagcaaaaactgtttggtatcgaaagtggagaagattataaattagcagtagctggagatgacactcttatagcttttgttaataataatacctttaaactagaagatgctaagcatgtttctgacaccttcaggaaagaagctaatttaaaagttgaacctgatgatttgaactttaatgaatggatgggtggtgaactatataacctagatgacattgagtattcgccaagcctacttaaaacaatgatttggcagggccttcctgggagaagattagatgacttagtaaaatcaatttcatgtccagaatcaaagatgatctcatattggtcagttcttgcgacattgaggggttatacgagtcttccaatcatgactccattaggtagagctttactaacttcattaggtgctttcgtttctgagaaatgtaggctccaagatggtgagagcgattttgatgatgtttataatcctttttcccctaacacttatttaccaaaatttgaaagtattgtcgtctcaccctgcgttagtgacaagatgaatagggacccgccctatttaactaaagataagtggaacggtttgccagacactggctggaaagcggtgttgattttcaagattgacttagatttatttggtgtctccgaatagaatataattttttccttcatatataccatacatatgatatattatatattttttaatataatatatgcatgtgcatggtatatatgat

SEQ ID NO: 366 - DNA, 3770 bp, Unknown
  derived from dsRNAs of unknown virus
gttaaattttactaattatttagttcctcatggagccccgctccctctctctaatcgaggttaaattaacagattgagagaattttcttctaccatcttactgatggcgcccaacgggtagaaatttaaattaacaaactattatgtcaaaccccattggcacaattttctcatcattcggtatcaacgatgatgagataacttctcagcaatcatcttggcttttaggcttagcctatgatgcccttagtgataaatgtgttgaagatggaattaaccttaaaattacaagagatgaatttattgtcgaatacagtttagcgtatgctaaaccgacttcagattctattttggagtattacactaagatttcaactgcaatatttgcttcaaaacacgatcctaccagtgcacttggctttgtagcacctttagcactccctgctattattggtggtactattgctgttggtaacgttttctcaagaaatagatattctacattacagaatgatattgttgaagagcttactaaacaagctggtcaagcagtccttactaaagtcgatagtctactatctgatcttgcaggtggtatacttggtggcggacctaataaaccaggaaagccagctccacccgctagtggtggtggtggtcgtggtgaaacttacggtggcactggttcaactcaaccaattggtgcgaactttgtcaactatgttcacccgactaagaaacttgagtataatcttggtattcccaacaccttaagaggtacggaaccttttgactctagcataactaatattgatggtgttgtttctagttgtttgactcttaaagttatcaacttcaaacttcctttagaggatgacacattcaatcagtattacactaaagtttggattccttcaattagggactatcttcaaggtgagaaaagactaaatactaatttagcttctcttttcactcctgacagaatgcgtgactatattgaaagggttgccgaagcacttcaaatttatcacttctttatcaacgtttttaactataacttacttggtgaaggtttaaattctaatgctggacttagatacattagagaaactatgttcagtactacgaaccttcaaaagttatcgttgctaagagaaagactagatggtttaccttggcctcagactcttgatagtgaaatcgcctaccacggttttatctacactcaatctgatgttaattatagtggaaacattatgaatgtacctgatatattcgtttccaatttatatcaaacaggtgatgctccttctactacagttattgattcaattcgtgctgatgtaattcagtccacaattgataaacttgattttaccgatctgacgactggagataatagagcgaacatgctgaagatgattggtggtatttgtaacactactgactttcagaactctaaagttagcagtattcaaatagagccatttacagatcctgtatttaatacagagtttgttaataactccctattctactcaactgtttccgatgctggaagtgtgagtagatataatgacctaacacttatttgcccacaggaaggtgctcatgattattcaccagtacctttctattcttatactaatgacgttccaggtatgcttcaggcgacatggacggcttataagaatacaggcggtcagtggaacggtttctggagaccagttacaaatggatgtgtattaaaaacaagtgctcctgaagcaactgtattcactgtatccaatgtaatgttcttctgtgatgaagtacccaactaccaacttattgattcaagtggtagtgttactcttagaggtgggttcgttcacgttacaccagcaactcaaaactgttggttatctaacaacttcgttgaatacccttgcatcaaccttgatgatactactggtcagtatgttgtgtctaagaagacacagaaaccatacggttcacagcttatcgtcaacatgtcggtgcaaactaactttaaccaaagaactcaatactggaaacagataatggagtctgctggttgggctatgggtagaacagaagatcgaatgatttctagtcctaaacgtactaagagatacggtaaggacaaatctgaagacaaggaagagtaaagtcttctggacctaacaaaattaaattgctaaccttatgtataaagttaaccgtagttggcttactgataacaaagatgagttacctaaaacagcgtacttgaagcttaccaatctaatgaactctatacaagaaggtaatgataccgttattctatctcctattgcaaaaagagatggatgggataacattcgagaagattggatcaagttctattcttcacttgataagagtaactggcctgatgcgctcatcgaaatggaagaatctcagcaagacaaacttggtccgcgttcaatcgccaaaccttggtcggaagtgagaaagtcagtctatgattactttgagtcttcatcaggtaaactggtatgcaacgatagtgttctgtcccctttcaagaccgctggtatgagagttttaagaccgctatccactgagcagacaattcagcgtattaagaagtcaactagttcaggtcttcctttcgtaactagaaaaggtgacgtaatagctgttactatgagtgattcaatgaaagcattgtcgaggttttggcctgccgctatgtatgaacgcactcaagagcaaggtaagactagagtcgtatggggaattgcccttggccaaattttaagggaagctcctttcttctttcctctcttaaagcgaatgtctgactcgccgtggctatcagcactgctgggaccggaagcagtagatattgcaatggatcgtttgattaagtacgccatccttaacgatctatctatcgtaaccattgattttagtcgttttgatacaacggttaaaggatcattaatggattgtagttgggaagttattcgcaactttttccaaccaagttatagtggagatcttgattctattgaatctgattttcgaaacgtaggaattttatgtcctgacggacttgtaagtggtgaacatggaataccttctggttctatgtttaccaacattgttggtagtatctcacacgcagttgcctctctaagcaccgagcttgtagatattaatttgtctcagattctaggagacgatggtgtacatctagttcgttctgaatcagtagatgaattcctggattccttcgaacaattaggaatgattgttaataaggagaagagtttaacgtctgatagatattctatctttctacaaaaactgtttcatccagacatcaatgtaaatggtcaaatcaaaggtgtttatcctattaatcgtggatttaataggctatgtaacatggaacgttacgataactttaaattagacgggataagtggagctgactacttcgcgattagggatctttcgatcatggagaattccaaatatcaccccgcatttcgtgagtatgtcctttggtgggcaagcaaatcgaaatacccaggtataccttctgataaagggattagagattatgtcgaaagaatctctgattttaatggaacagaagggatccttgttaatcagtacggtgacaacatccgaggcataaagacttggaaatcgtaccagatacttagcgaggaatccgcttaacattaagggtaatagtgatattacccccc

SEQ ID NO: 367 - DNA, 1683 bp, Unknown
  derived from dsRNAs of unknown virus
gtaaaacttttaaacaatttaaaaatttatgctagtgaaaactaggtaattctaacaaaattatttatgaaatatgaaataattaaattaacgcaagattcgattgatatgtatctatctgatagtgcacaacaatctgcttccggatattttgaaaacttgtcgcgcggacagaaccctactcaacgtaccccgctgtacaaagatctctctagtaacgaggtgtttgatctttgggtaacgtttctgaaagcccgtatggaaagctttgaactagaacgtcctttaatcgagtacgacatgtctagattaggtaagtgtggtccacagggaggacttaaacctctagatgatcgtcttgatgatctattcgattattggcaactacccgataccgaaaacgttataatcgataaagattgtatcgagcaagttcggaaagagctatttggtagtgtgagagataaacgacctcttacagtcgaaaatgttattcagagagatgaatttgatgataaactcattacaaactcaggctctccagattttgcgaaacgtaacgatcctgccgttcagcgacacgcaattgatgacgcaaagtcaggcaaatggattgaataccctatgattttgggatctaggagtcaacgagggaaagagagatttatattccttgcaccatttagcacgaatattgttgaaaagcaatttctataccccttgatggaccatattcgtaatgcgaaaatcccgttctttgctgcatgggaaggattcgccgaagttgaaactgattttgaaaatgtcaatttctttaacgatcaagtttcatacgtacaacaggactatacgtctatggataagtactttaactcaatgctcggagaactagtcttcgaagtatctaaagacttttaccaatcaaagttccacgacgagtggcggaaggtgatccagcatgtatttaatataccggtaatgacacagcttgacaagctagtcacaatgccacatggactgatgtctggatcgggtttaacaaatttccttgaatcgatagtgtcgtactatctaacttgtaaataccgaaacactttacaggaaaatatagacactcagggtctaggtgacgaccttgttttcaactataatagtcgcaaacactccgaggaagatgtaaagacagtaatgttcgacgaatccgcacaactaaagttagtgttaagttcagataagcagagattcgatcagcacacgacagtatacctacaaagatattttgatgaaaggctgaatatcaatttaggtaattatcccagtatattagctttaaatactgcgatgcatcccgagaggtttcacgacgcctcgaaatggagtaaagagatggagatactccgatggattatgattctcgaaaattgtaagcaactgccttacttcgaagaactagttcaattctttatgaaaggtgacaagtacaaacttggacttgaaatacctaacttctttcaacagttaccaatcacgtatgaaacaagtaagtcgattaaaggctttgtaccttcttataatcaagaaggtcttgatcgtggaattgacagtttcgccactgtacaatatctcatgaaacaaagcgctataagctattagcttcggcggaccagatctccatctggtctc

SEQ ID NO: 368 - DNA, 2204 bp, Unknown
  derived from dsRNAs of unknown virus
gtttaaaatttataatcaaaatatacatcttagatgagtttttccccagtttcactgactgtttaggaaatttaccatttatttctttcagaggatatccgtccctctacaaacaacaagacaactgaacgttatagtatcattataacagttaggatatttaatcttattaaataaattatcatttatggctaaccaaaatgatccagtaagaaaggcacttagatctttcaaacggccttatcctccaggagcaggaaaaaggaaaagaccagcggcttttgtatcaccgacttacattcctggccgttcatctcgaccgatgtcagatccaatcaacccaaaaactaaagttcctgaaggactaaccgttgatccgaacgtgtctagacctacgaagatcgagcttaacaaacacccggaccttaaacagtatgggcactcaaaagagttcacgtcaaatagtatacttactaatcctgaaactactggtagctctttagcttcggagaaagttagtacacagacttcaactatggctgaacctaatcctacaagcgtcggaatagcaacagcaacagagactcgtgaaccagaaacaaccttaggaggtactatgatggccgtacgcggaagatttcccagcaatgaagaccatgttccaatggatagaccgtcaggcttatctagatatggaaatggcgtttacacggacgacaaaagcctgtcgtatcccgatcaactcaatcaaaatccaatttatccacaagaccccgcttcgtgggataattttcaacacgttagaattctatctactgttgtaacgatgagattctttcctcaattgtcttttagtgatgatggcaaacaatacgatgtcactcaaactaaatatttcatgaacatgttcgatgaaatgagtgtaaattaccgtgctaacaaacaagccaatagagactttgatgagcatttcactctaaacaaagtttttacttatttccacgacacaattgaactatacacggaattgtgcaacctcatggctcgccaagcttatgtagttgacaaagcaaatccgaataatccagctaataacttaacgttggaccagatatcaatatatctgaacacgacagaattttgggtattacgaaaccgaatggctaatgctctagctacgtgcgtcattcctgaatatttctggaataaatacagattcatgtctcaattacatcgcatcggaccgatggagactgcaactaagcacttctttagtacaccagaaatggatactttactacgctcagctgctctatcaggaagtgattcaactaagaatgctactgtacgatcgaattacattaccaaaatgaatgcgattgtagatagagtagagtttggacgcactctctctgctcccgctctgaaacgttatgtcactggtacaactaagactaatgttttcgagagcgcgactatcgcattagacaagcgatccagaaatgctatttctgataagcttcaatattgcggacttaattttaagtcgacgggtgatttacctcctttcccttcacattcggtttacaacccgaaaatgtgtgacattattagtaacattagtgcttacgctctatttactggtgggcatggaattcacaaggcttatccgcctattcttcctaacgatgcaactaagaagccgactttagaagcgactactgcgtatacttcgatgcgacaaccatcagagcaagacgctactacgctagaaactctagcttctaaatttaaaggttgttcagcgctacatatggactatgctaaagaactcgataacgtcgatagtttcgttggtattagtgccacaaatttcagaactgctactagctatatagctgaagcacaaggtgtaactagtcaaagcaccacacagttcgctatgtatccgttaataaccgcttacgctcaaaatgcatttgcttttgttgaaagtaattttacaactaagttgttcttgagtgattccaatacaggaattaaatactcaagtaattccgatgacgggaatgttcctctatactacgcaacgtggggtggaatacaacaaagtatgtttactactaaggaaagcatgtttaagagataaatcgactagagtcgtgggtttcccagctgggagtaattggtgtttacaccatccc

SEQ ID NO: 369 - DNA, 2010 bp, Unknown
  derived from dsRNAs of unknown virus
gaatattatagtcttatctatgtcatatcatgaacattaatttctattcaacgtacagtgttggtgtcaaaacacgactacttggaagaaaattacttcgaacaagagcgcgcgcggcgataggatcatttgtgattggcaatgccaaaacgaacatcgatccaaacgcgctgctactacggaaggatagcgcacgcatctttattgtggatgcaaatgattttaaagatctaatgcgcaacatgaaatatagcgcagagaaagctattgcctattatgaagcggtaacccaaataccgcatacagttaggaatttatatgcttataccaacaagaaacataagcctccatcgagtggatcatcaggtatacggcgtatgccaaaattaacttggttttctaacacatgggataaacactcgtgggttcgcaacatgacgaaagaagatggtggatacccatgcttctggactaaagatcatagtgcaatcactgacccatttagtaaagcatggaaactatacgacactaaatttccggatagggggtggaggataacttatgacgtccacaccgatattgattcggtattcgctgagctaacgagtttcattgaaatgcatcaagacgaggaagaacttcacgtctggatacaaggctctttaaatggctcagacccttcaatggttataaatgatttaaagaagctagtctctggattaaacctaaactcttcacatataaacgaggatgttaaagtaatcctgatgccgtcaggttcaggaaaaacattttactcaaaaatgtttgagcatgtgatagatatcgatgacatatataatggagcaacttcagtgcaaaaacgtaaaagaaaagaaacaatggaatcagagtcttggacactgcataacgaagtgaatgcggaaataatactcaaattttatgaagatggtggtttaaataacaaaattctattaactcacggcgaagactcattacgtaaaataccatacgaaattgttggtaaatataaagtgccaatgagtgagctagcaagcgtgttagaggaaagatcagacgatcctttccacgtaaagatgactaaactaaattggtcaacgtcaaattatagtattaaaaaccgtgatgaaataaaagacctaattcatcagcaaacgtcgactatgactaccgatagtgaaataaaggttgacgtgcgaagtactgaatacacatctctctgggatacacctattgagaagtcgtatgatctgtgggaaatgtatggttcgaaaacgccaacacgtattcccgtaattccatggcgagtgagtaaccttgggccaagaatatataagaatggattgccacctcaactattcccaagcacgactatcatgaaaaagctaaacatatcattagatggattgaacacgactgaaatttatggaaactatagtgaattcgtaacgcttagtataataagtgagtctgatataaagactttggactttggatggcgtgctgttggaaacaacttgtatgcaatgtctgaaatatctgaggataattacgcggatttatacaaagttgaggatataaaattcttcatgggatgtggctcagtgataactgccgcacatgcatgctttggagtagggagatcgaatgatgaattattgtttcaactggaaaggaagatgaatactggtcatggcacatctggccatatgatcgcaagtgtgttagctttccaaagtcattttctgtggtatttagaagaagtatttgaaaatttccatagtggtaaaagtgtttacgtaaccaagttcaatgaaccaggatctggtgcgtaccacacgatacatgaatatagaaatgcaatacatgatatgaaacggtctgatacaaataagttatatccgggatatgctagaaacaatctaggaatatgcgagaaatttgtcagtaatctacaaatatagaagggaataaggctatatgaacatc

SEQ ID NO: 370 - DNA, 3271 bp, Unknown
  derived from dsRNAs of unknown virus
taacacattcaggtgtcagcgtgaaacgtcatacacgtgtaagtccacggcgaaggcccgtgtgtatagcttactgtatggcgagtcgcgcgactgcttttcagggattaccttcaggggagaattgggatgactctggattgcttgctgcttttaaccatgatttcagccaaaagatcaaggccttcgcaacattgcagaagattcttggcagtccggcggttgagaaatggtatgaagagtacaagcaagcacgtgctgtgtcgcttgcgctgccctcccagtggcagacactagggatgaagccggaacattgggaagctcatgtagagtcgaactctaaacggaaggcggcgagagccaaacacagcaccacagtcaatgagatatcggcgaagtatcagaaacaaatccgggatgcggaattgaacctagaatcggaactcgcggcgacggctaaccccatcaccgcagtaatcgagctgggttataatgacctcccagtttctgatatcgttgctatcgaagaagcgcccgatgacactgctcgcgcagcaatgctcaagtcaaaacttgacgcactgcggcgaacagcgattggggcgctgccctgaggacccccaagggtcccgcctcgaagcgtattcgcgtgcgctaagaggaacggttcaatgcgcggtgcgctgcccgtgttgcagagacaacacgtgatcaagggtgttaggaagatgatcaaggcggcaaagaagttaagaggggcgtacaagcatatggatggtgtcttcagtgatgacagtgaagacgccctaaaatgctcgctacgctacaggatagaaatactcatgtcctttcaagtagaacttgcagagcgagtccctaacggataccctgtgcaggacccatacaagtaccttgaaaggaaggcaaaagcatcggacggtaaagcaaaagaggcggatgataggggcctgtcttggtttttcaagatagaggccagggctacgagatccgtagctggctcactcgccgaagcgggaaatgaggagctccttgagataaccacactacaggccacatattatcactggcttgcaagagaaatcaaagagaagcgagctcccttaccggacgagatgcccatgaaatacaggttcagtaggtggaagtcgaacggcgttcctcgcgagattagtcacacaaataaggcgacatcgcatgacgtgattaaacctcacgaggatatcaagaacataggtaaggtcgagttactaatcaggaaaagtaacaaggtcatacccgttactggtgaaaacgttcgatttgaatcgaggattcacaggaaggttggcacacgaccccaacgtttccacaatccagtacggagcgagcagtccaggtccaggaaggatttttcggacgagctcgacgagtacgctgaccctgcgctaataatggcgcatggatgctgggacacgaacatgttagatctgaagaggtttggagggaaaaagggaggtactgcaggcacacgatcaatcatagccgcactggacagagtggacgagttgaacctagtcaggataccgacgcctgagccaggcgattgtatgcttaccgaagtacgcgagtcgagcgattcgggtgcgatggggtcaggactaggtgcgaagaaagagaaaagtgtgggcatgtttggagaggtgctgcaagagacctttgagaccctaggaaaagcgaagtatatagacgtatcaccttacacgtgtggtggcagagagaggaggaatctgacgccaatggatggcgaggatttaagatcacgactagtcctctgtggcgatctcgtgacggcgttgataggatgtacttatgctcaaccgataactgcctcaatcatgaaggagcgtggggaagtaaggctggggctaaagcaggatgaaatgtggtacaagagatatctcaaggagatccacgatacagccttctcgcgagacttagatatatcacgttctgatcagagcttgtgcgaggagctgattgtgggcgcgtttgggatccttaggtcgatgtttgacgaagatgacaagagagtggacaaccatttctttttcatgatgtcgtcggctctgtataagagggtgatcataccgggaggtcacattgtcactattaagcgacatggacttccatcaggtcacccctttacaagcctaataacatctatcgctcactggatcgcagcgcaggacatacacaagcagctacgcgtggagaattataggatggagcagagcggcgatgatgctcggtaccactatttctccgcgtgggatatgccaaaggtagatgcgtacgtatcgatggcaaaggaacgatggggacttaccataaagccgggatcacagaccacagggaaagtgatggcgacggctgaaggtataacccctgaattcctggcggtacggcatatacacggttatccgacgcgcgatttagcacgaacttgggatatctcgctcttgccgagaaggcccaggtgttcgcccacgaggcaggccatacgcatgttctacatggactcgaataatcccttccttaggcggagatggaaatcctacatagaatatttttgtaggatgaacgtcgctgcaggacggatatttgggtggtcagattcacaggagtcaaaggaggctattaatcggtacatgctcacgagagcactagagcgcccagcacgtgttgccagtggcgagatagggaggccgaggaagcagccgtgggagaaggggaagactcctgttatacagcttgtgatgaggcagaagaagaggccctccgttaagtcccggatactggaatggtaccgggggtatataggaggtaatttcgataccgtggatatcgaggacgacctgatgcggcgcagtatgaacatattgcgccacatcaggcctgctgatcgtccgaactgcgaggaatggtttacctgtgagcttagcgatagcattatagcggcgtctaccgagagggatactgctactgctggaatgaagagtatcgcactataccggagatccaatgagatttccagtagcgtgctcagaagagagatggaatttatgtgccttgtaaaggagtacggaggcggcatatacaggaggaagaatgaggtggagtgaaggatacaaattaccggacgtagagagtcaagtgacctggtctcacaacatgagatcgaaagctagcgcaatactagtacgttcaacca

SEQ ID NO: 371 - DNA, 3017 bp, Unknown
  derived from dsRNAs of unknown virus
atcgactacggaggacatagtactccgtgctcagtgctgcagaggatctagtgatatcctcaattatagtgatgccccctaagacggaggaagagaagtttgatgagctcaaggccgccctcttcctcgaatttcccccgctacgtgggtctaccgatgccgtcgtccgccaaatgctcggcaccaagtcggtcaagccatggtatggtaagtacaaggagcgggtcaagcttgaggctggacttcccgaaggcatgggtgccgccggactcaccgcagagatgtgggactgggcacttgacgtcaagaaggatcgttccacagcccgggccgcccacgccaaagcatgtgaggagctggcccgcaagcacaagcttgccgtcgacaaggaggacgcacagctcgccgcagccctcgctgacaacgactcgcctctcattcgcctcattgaagccgggtacgaagagcttcccctccgcagccaggcaagggtcgctgccattgaggacaagaagctccgcatcaaggccctcgacgatgagctcctggcttaccgcaagaccatgcttgcccagctctaccccgacaccaccaagttcacccccggagacgagggaacacggcccgtcgcctagggggcaggcaacccgggtccggtcaacggcgtcgagctcgggggagccgtcgccagctttgagctgctggaaggtgttcgtcgaatgcgtgacatgtggcgcactcacaggagttcctttctggagaaccagtgggtgcctgacccggatagggaattggggggaatggtgggtaacatattgcgggggtggggaagacaggtcctcgatggaccagggctcgagtactgggacgcagggcatccagcttggcccaatgataacgccgtataccagtcactcgacttctttagggaacgcgctcgttcagcaccgtgcgacttacaggcctctgcactcgagcgactacagcatgaactgtccccaagggcatgggaccgcatccaacatgaattcacatacggaaacactccagttacaattgcatggatacgctggggctgccgaagtcagcgcttccgcactaagcgagcgcccgactccgtcaagttccagcagtcatacacctcttacgtttacgttcagccatcgccagttagccgcactaaagtatgcactttccctcccgtcacctccgaggacgctcaaagagccgccagggccgccaataacacccatatgtctgagcgggccaagcagcagtgcgtcgtcgctccactcgagcccaattccggccttcatttcctcggccgcaccaacatcaagcatggcatgcggcccactccatggcgagatccaagtcccctcgtccagcagcacgccctcgagtacttcggagcctctgacgtttacgaacccgaccgcctcattgtccatcccggacgtgaaacctaccttgcagaccttgcaacgacccttggagaccctccgacctacagcgccagcaccaaaaccattgaaggaaccatcaagcgctggggcaacaagctcggattacgccgcgtgctggcagacgctcgttggggtgaagtcggtcgaattaagtgcaatggcaaggccaccgcgggtatcgcgctggaaggactcggctacacccgtgcgcagtgcgcggaatccattaaacaactggcaggacatgtctcagatctaagtaaggggcaggcattggggggtgcgggcttgtggcagttgggggggcgtgcgaagcggaccacccctgcgaacggggaagttctccgctcgcgcgccatcatattcaatgacggggtcaacgcagcagtgagtagcatgatttcacagggcattggggaggtcttcaagcggggcgacggtgacatcaagattgggcatcgcgcgcagcagggtgcggcgtcggatgctcggcaatcggagggaaatgaagtggagttcgaaatcgaccataagcggttcggtttccgcctcgctgagccactccttgtcgatgcgtttggcattatccgcgccatgttgccccccggaattgaatgggacctacgtattttgcatgagatggcacacaacatcattaagactataatacttcctgggggctgggtgtatcgggctacatttggaaattggagtggaccttggacaagcattctcgatagcatatgtaactggctggcgacatgcagctcgctagattactatggggtcaagccgacaagcgtcgacttgtggatttacggtgacgacacattgatcgggtttaagcacgggcagcggccgcccaacctttcaccccccgatgtgcagcgtgtcctcaaggagaagtttggcatttatgcgggagagtggaacttgggtaatctgtcatcgtacggcagtaacccaggggccacctttcttggctgttggaatcggaatggcatgcacgggcgccccatcggcaagtggctcgacgtatccatgctgccagagcgcaggcaggatgggctgcggcagcagtgcaaacgtattaaatatttatcgcacgctgcagtggccacacgtgataatgaggattatttcactagttacttcacattcttgaacgaccgtaagcctgcatttgccaggctctcatccgatgcactcgggcaatacctgggtgacacattcgcacgctcgcacgctaattttagctcgggtggcgtggattggcgagattgggagtatggcgcaagtacacagttgtgcgagttaatgtcgaggaaacgcccgcgagtgactgagctgatgcgcgctcaggtaacgggcaagctccccttcaacaggtgcgccttacacgccacttggttgatgaaagaggtcggcaggcagccgatcgggttggtgggagtttggaggacaaccagcccaggcctttacgtacgtgatggcatcgcaccagcacccgcatcgtgagcgggaccgcgtgatcctagagaataggaacca

SEQ ID NO: 372 - DNA, 1736 bp, Unknown
  derived from dsRNAs of unknown virus
gtaaataaaatcaaccctcccactctatcgaaatcgtataagtacatattgtggtatttacctcgagagaacagatttaaatttaatagaaagaaaactatggcaaacaagaatattcctggttttgtaggccccatactaccaggtaaaggtaaagcaaaactggcaattagtccacaaactccgacacttaatgctctgcaacccggtacctctacaagagttgctgatattactcttaaggcaagtaatcgatcgcagactggtaacaaaagtgcgggtaaagtaacaaagaaaggtaaacaaactcggaacatggatgtacctccaaaatatactgctccagagttttcagatagtagtagcagcagcagtagttcagatagtttccagcaagattctaaaagaacaatcttttatgacgaaaatagggacttaccaattagtttcgatttagatctattagatacaacgactccagttgctcttgcacctgtggagatggattattcatctagttctggtaacaatgattctagatttataattaatatcgctcaatacgccagaaattttaacggtcaagcctgttcaacagcaggctatcctgtctacgatcattatgttatattatataatcaaatggttaagaaggtgtacgcagttgtaagaagtaaaattgtagacgcatttacgtttgctaatttctataattacattcagttaatgactgcagctcttgagctattttatactactgacgccattctttcgtatacttctacaaaagaggagaagaacactggagttatgcaacttcagcgtaaacttactgagattgatttattcacatctcagaatgagttaagacgcttactgaaaggttactggtttccggagaaattttctaaattaatccgttggacttatcagatttataagacgtccgaccttgatcaggcatgtaattatatgttcattcccaatgaagtatatttttacacttcctcttcaatggatgtcgcgacagcaatcaaggcacaaactgatcatatcattggtgaacttactactggtacatcagcatctaactatgttaaaattgtttctgtccttggacaggtttatccggaaggtcttattgaaggacttccgtttagtacaaatcgcgcaacatatgatccgcaacactacgaagttttcactaatcaacccgttctttataaagacgacactactgataaggtttaccctttctcaactagtgattcaaatattgtatatcaaagaagttgtgataaaggcgttcgttcaggacttcctttctgtttacaatatattaatgctcttgaaacaagggatggtgtaggtagtattgatttcctttcctgctatatgcctaccgcatatcagtcggataatgttaatttaataactaataaatatgcattaactgaaggtggttactttagaccaagatttggacaatatgttcttaacgaatctgcagacgcacatgttgttcatatggcttatacatcttcaactactactaatacaatatatttaaagaaatctggcccagcacctggattccagagagtatattttgataacgcgatggcaccacttattaatctaagagatatgatggatgctctcttcgagtttacgatttaacttatttccgggtttgtcttactgtaatttagaacattagatgttctaaccccccc

SEQ ID NO: 373 - DNA, 1483 bp, Unknown
  derived from dsRNAs of unknown virus
gaatattttgagagacacatacacattttaaattgaaaacatggaatttaatattactgatgaggtggaggattatgatgaacaaattagagacgcattcgaagacgctgaagatttaattgatgataatcctgaaaagacttctcgtgatcgtttggcgaacgcagatcttgaagagatctacaagggcgtcaaaaacattaaagactgtattaacaacccgcttgattcgcgtcttgaatatgttggaatcgatgccttgcgatatgtagttagttcataccatgcacgagattcggggctcgaaaaatcactccgcgataaatatgatgaacgtgttctcgtaacgcaacgtcaggaggcactaatgaataagataacgaaagaacaaacagaactgatttcaacacgtgcacaattgcatggacttaaaaaggaactactgcgtatatctaatgatgactttgatatcacgaaaaggctcaagatgagatctctacaggaagaaatctctacgtatgaatcgatgaagaggtctagtgaagagcaggtggctagggacatagccattgtaccgaggatccaagcggattacgatgccgtccttcgtgaagttgatgatctattaagtatgacgtcacaagtattgtatggtccagaagttatgcttttatgtgcaccaaactatgtaattaataccgatgtgaacttgccatacataactagcagaatcagtgatgaaattgagaacggaattgtgccaacattaaaagagcatctaaacaagataaaactctttaaagatgaaggcaagggatcggagtttgcattgttttcgggaacaacaaatttaccacaacctttaaaggctcatggcgaagaacagagtttattgtccggaccgctaatttctagttataatttctttaagaattcagagattggaaaggtgattcataacatacacgagaacgcgctttttatgcaagtattcagaggacaggaatttgatacagctcgacaaaatgaaatcatgatgaaggatccaattaaaaacctagacacatcattaatgaacgaaatgtattttctaaacttaacgtgtatgtctggctacgatcccattacctgggcacggtgttttggagtaccaattagtggaattggaaaacaaatactgaagggatggaggagtggcggtaaaagaccactaaatgctgacggcctaaggaaaatattccttgaaggtgaggtcagtaacgaacataatctgctacttgatgttaacactctcgagtacaacgaatcaataaacgataagatgaaagagaagcgtgacgcacaaattgcagcattgaacgatactcaactgataaccgagcaggttaaagctaaaattagatttgataagcttataagaaagggcacggactagttatggtttgatttacgtctagttacttttcttctcaaatgaaacatc

SEQ ID NO: 374 - DNA, 1798 bp, Unknown
  derived from dsRNAs of unknown virus
gaatattatttggtttatgaatattgccatataaaatgagtagaaatgaatcaaagcgtaccatatccagggggcaaaccatgatgagtggaaaatctaactctggtgctatatcccaaaataacaaatcagcagcaactgactcatctaatgtgcgaagcagaagaggcagaaatgtggtaaaacgcgattttgtagatggagtaaccatcatggcaggtaaaaccctagatggcaaaacacattacgcgccaacaggcaaggatctcgggataattatttcatctgaaaatgcgcgcttagtagcagaggctaagaggctcaaggctgaagccgaagcagaggcgaaaaggcttgaggctgaagccgaggcagaggcaagaaggcttgaggctgaagcagaggcaagaaggcttgaggctgaagcagagaaagaaaggaaggaagaggaagaaaggaaggaagaggaaaggagaaaaagggaggaagaggaaatgagaaaagcagaggaagaaaggaaagaagaagagaaaaagaaggaggaagaagataagaagagacaagaaaccgatgcggcttacgaagagtgggatcgaacgaggcaagagcttgcggatgcatgggctgaaaacaatgattatggagagcgtgatggagtatacgacgatatgtattatcccgattatcaaggtgatgaagagtcggacgattctaaaagtagttggaacccgtttagtaaggagtcacttcaaggtattcatgatttgcatctatcattattaacagctgataacgcaaaatcgatatctgacgtaatgcgatactatgagggcgtaacatatgacttaggaggagtgctggcgataccttttctagataccgcgctaaggaagctgactggttcaaagacagttggtagagctggagggaaagctcagagcaaactggcgaaaagggcgcatatggccatgtttttagcagacgtgtcacgagccattcgtacaggagatccgcaccaagcaattccaaaaatgaacccagatggtgttggtggcgatggagagtttatatcgatgccatttttggacagattattgcgaaccgttgatgtgctaactacaattggtcgaggcgatcctttgaagttaaaagatttgccgggaatgggtgatgtatcgcaagatggtgagtccgaagattttgttccaggattggttggtaggatagaaaacttctttgcactatccaatgagttacgattcgaagcgcttactaaattcgacagtgaggcacatcgcgttagatcgctgcatggaataaggataattgaaagtgataggtactataccgtaatgtatcatcctgatagtaatataacatatattgaatggaacccaaccagcgacataaggaatttacgttctaagactggtgaagtgagcagggaatggagtgaggacttcttagctggattaggtatgaaaatacctgcatggtcaaagcgtgtgaagtacataaaggagaaatacggaatggaaagcgatacaacaaagcattatggatattcccgcggaggtggcttggccactcatctaggtggagttggttatggtaccggttacttttcctcttacctaccacatagagcttctaagtcgaaactaagtggagataaaatgcatgacttgataatcaatccattatcttatgctatgatgctgaggaatataactcgtacatgaaaaatatggacaatgtattctagctacattgaattatggaccacttatgaaacatc

SEQ ID NO: 375 - DNA, 3442 bp, Unknown
  derived from dsRNAs of unknown virus
gaatatcattggtagaatctttaaaaacagatgtcaaacgtaaccgaaaaatataaaggtaaactcccacgccctgctaaggaccaaagcgtcaaagagttcgaagaagaggaaattaagccagatgccgaatacactgaatttaacagcgtgaaggatatcttggccaaacccgattatttcgagccaatcattaataccccagaattcatgagtatgctggagaaggaaggaattacgattccgaccttttccgcacagcccaaagaggcaaaggtagatgatgacaaaaaggaaaaggtgattaagcaggaagaggaacctaaagaatcgatgaagaacactgacgaagaggaacccaaggcatcaattgatgtcgtaatggtaccttcattggaggaaatttcacccaccgatacgatgagcccggttgaggaaatgccatctaaagctcatttcgagccggtataccgtaggatcgtgcacccattaaccaaaccggtatcttttgatgttacgcatggtttggcgacactgaataacacaggtcttgaggacatgtacatcgattacagtggtgacagaacttccaaaaagggccgtgtcctcttcagatggctgcagacgtacagacctatgagtagagtggagtcgattaagtacgactcctccaccggcctggtggatttctcaaatcatagtcatgtctttacttccgacgttgcgggtaacagcgcgacgtctcatgcgtatgaagtcagtaccttgcggccgaaagtggaagtggcacaaccaggcttcagagcgaacgtatttgctgatgccacgatacccgatgtggtaacgtcgcagattgatggacgtgttatcgacttatcgatttcctcacgccccattggttcccgaatcaagtctgcggacgtgattatgaacccatggcgggcaccaatcatgctccgtgacatggctgcgtataattacatgactttatccttcaatgattggaaagatgtccatgtcgattatataaatcagggaatgctgaggtatgttcgtgagcgtaatgctaaagaacgagatgtaattactaatacaacgctccagaagacggcgtatgatagatacatcattggaagcgctggcgcaaatagcgtcacgtactattatgaaacgataccaaactacgcgcccgttctgtgtgaatccgttcttggcagatccttcagtaaagcgagtgaagccatgtctacgatcgcgccttcgcagcgctcgatatcgacaaacatcacgaacaggcaggcgtcaagcatgctactaaacctgactgcggtgcaacctagtgctggagcgaacttgatgcgcgatctcggtgcttacttgcttggtggcaggcgtcatgttctggaaattgatgtagatgacggggctacaaagacaccgttgctaaacgccttgagtagcatggcgtcgttaattgtactcgatagacgtttcatggatgagcggagcaaaaggcagctacttgtaaacgtactccttccattctatgatgagtttcctacaaggcgaaacaacgtaagagatgtttctagaagcgttcatgaaatcgctgatgacttcttagcgaatgcagctacggctatcctcccggacgtcacaaaaatggtggatcttgctggacgcggtagagcaaaggggcgcgaaatcaaaatgatactgcaagacctgctaagaaacgttatggtgattaagttcgaacagctcggtgaaacggacaacatgttcaaaactggtgctgctcgtccatacatgcccttttcctcacgagatgatattaccgacattgtactctttggtacgcgaactgacggtgatgaatcacgcatgcatgaaatggcatcgtatcgaccgggtgctataagaatggcaaacgctctcgagagattctcggacgttcttggacgtcttagacaattcgatggtcttggcctggctgttagtgaggcgatgaaaaccagttcacacctacctgcgtccatggcgattttcactgacgctttcgtgcacggatcagttcatactgatctgctgtcggcaactactcaggtaagatatgagaggtccgttggatcgatcgtccttccctttgatggcgctctttcattcctcctgtacgggatcggatcttcagagatgtcgacaagtaatgactccttcgtcagattcaaatcgttagcatcacctacgatgccttcattgtatccggcatacctgtactttgagagatcaattgtgggtagtgcttacgctgcattcaaagacgacctcctcatcacccacttcgacatggtcgtaagtgtgtgcctagacgccctaaaagtgtatttcaacgccgttgatcctgaatcagcgagccgtatctcatacctgttcgatgagagggagacattggaaaaccaaaacttggagcttcctgcgtctctgacatcatcgattttctcaacgcatcaatacatgccaaaaatgggagctaacggaccacaaaaactacctggatcgtttgagactaatgaacaaatacatgagtcaaatggcatggtgaacccctacaaggattcacttgacgcagctgataagataataactaagatgtacattgatttcaagcctcttgtcccaattgatattgagacgtacaaccagggcaccactctcgtttacaccaagccaagccatgatgatgcgcgttatttaagcctaaaggaaatagtcaaagaggcgaggtacattgattccttagaattaagcattgatggtatcaagaacatggctatcgcccaccttaggaggatggaaaacgacgaggagattgcaatgtatgacggcgtcatgatcgacactttgatgactacttttaaattcgttgagcataagggtctaagtgatttaatcgtggacacaccaaagatcaaaattgataggaaccctcgtatgctcgacactgacttcgaagtgtccgaagtgtcaatttattatcatcgtgtaactgataggcagggtgacttgagcaacccagcgaaacgtcgagagcttgattatttgaacggcttccttacttacgtgagtgtgagcaagaaggaaatccagaaaagtttgattaacttcgatcacatagatccgatggatccgtcaatctataaagttatcaggaaccaaaacgaaaatgtccgccttgaaccgaacgcgctttctagcgtccgaattagagatgggcgtggaattacctatgccggtactatgactctgtctactagagaatccgaggaaattggaattaccacatcacttaacccaaaggaagagttttgaggtagcaccatgcactcatgggaaatgatttttaaagtaaaaagtattctatacggaaccaatgtgaaacatc

SEQ ID NO: 376 - DNA, 1433 bp, Unknown
  derived from dsRNAs of unknown virus
ggtttaaaaagattaggctcacttcatggctggtagagttcgcgattatgtcgatttagataccttttgtttgactgacggaaattgtatgtcatcttcttatattgtcgcagaagctgcagatagagctgattttccgcagggtttgactgaccaacaacggttgaatttattcaccgcagtattgctaattccaattgttacaggcgtcgggtcaattgtacgaggaccaattcacttgtgggaacgtgcattgtcggatttagagccagacgatctagtggtcgatcgcctggtggggatacttgatgggcgtggtaacccaggtgaacacgtgaatactgttttaccaaattttgatgaacacaggaggagtggatatttgaatgatgttctcgagggaatctcccgttaccgctaaagttatgggatgccgatgttctgtgccccaaaaacaacctggtatgcgatttcagactccggtgactgaaaatgatctgaatgatggactgcgaaaagctggatatgatggagatccgctaacggctgagaataaacgactattaactgaatttggatatgattttagcgagaccagtgatcatcgagacaaccaagatgtattccgtagtatggatactatgaaatatgatgtggtgcaactcgctcaacgtgctgaccatcattggtgggatccagtagacgatggtacgccacacagtggcaaccggtgtctgtacagcgatgtgaggtgctatagtggatacccaggaatgtctgaacaatatagtgttacacgcatcgatgatgcaatgcgtgagaggtatgtagactgggataaaggagggtatagcatccattttcgaacaacgcgtagtcacaaatggcacgttttaatgatgtttaattttctcgaatcgagggtacctctagaagttagacgttgggacatcactaaacatgataattcgaaattctcagttgacgaagttcaagggtatgttgaccgatgggtgtggggaacgcaatctgataaatgggaattagcagtgaagcatcactacgctaacaatgaccatcatcatgaatattgggttgacgctgatggtgtagctactaggatgccagaacgagcagtggaacatgccatcatcgataaattggcagttggatgggaacgtgtgttttcgtcaaaacctacgttaattgaagacttagtggccaatgcgagaaagtttccgatacgtggacattctgaatccgttgaatattttaaccagaaactagacgagatcgcggcattaaataccagtgtgcatgttgtcaagctgtcgtgcaaatgcctacagtaccatacggacccttgtgacctacatgagtagtcacgcctgggtctgagctctatggtgtaggtgccaaacatctttccgacc

SEQ ID NO: 377 - DNA, 4747 bp, Unknown
  derived from dsRNAs of unknown virus
cgataaaaacagaaaacaatgtcggttgtaacaacagatgtaatggatactgatagtgggtcagaaattgacctgcagggcttgcccaatctgcaaaatgcagagagtaataatacaacaggcaataaaatgccaacaacagatgatagtctgaagcgcatccatgagcgccacaagaatagtgccgcttcaaggggccgtatcgaaactgtatctaccatggcaggcattgatgttagtggtggggagttccaccagaatttgcaaaaaccttacagatgcgattctgtcgaagttggcgcactttttagcaccggggccaagatgccaaacttgaccactgataataatatgaagaaaggtgctgctcaggctggctttcaacctggtgcggtgcctcctacactatcttgtgactctggggatgctggttctggttgttacagtatggttatggagcccagcctggagctgttcatggaaatgaggggtatggcaccgaataaaataaagtgtggcaatactgagaatgctcttgtcgctgcacccaacggtcaccctttgctgaattctgtttgtcttgatattagtgctgaacagattactacagaggacggcaggctgatggggtatgtgacaggcagcgcagtcgatcgggctaagctcgacctggccggtgacatcgccggattagtcggctccatgcctcaacgcatctacggcatagctgcacaaggcgctaataaagcggaagctaatcctgacgaccctttcgatggtcagatcaatagggctggacgtgctgtagatactaagaatgtcaacaacatgatcagtcagtggctctttccaattataccaggcgaaaaccacatgcccctgtttataaacatggctatgcatatgcgtgaggctgcacaactaagtatggttgcacacatgcataatggcgagggctgcaaattgggcgcgcactacacgcgttttcgtacacctgttacttcaactaagaaggtcatttaccctgctgagttggtcagcggggctggtatggattatattccggtgtgcggctatgatcttgctgacggccatcttaatctgcttgcgattatgcttcagccctgccagacggtgggcaggtattgcgagactgagatcagctcgctcaggcccgctagtgcacgttttgtaatccgttacagtggtgctcaggccggttacggcggtggcagattcaaacctaattataagatcgtggttgcaggaaatcagtggaattcaactgaccgagaggttatgaccaacagcctagtttgcgatcctagggctttatataccgcggcagctgcatatgcagacagcatctgcgcgaggcctttgctcgaggatgctatagagatgatcaacagggtctgccctcattatgaggggcgtaacttgccagctaatcacgctatcaatatcagaggcggagtacctaggcatgcatcggattggctacccaccaccctaaagaagatggaggaagcttacccagcatatacgcaccccagctatacagagcacctgttcgagctggttacggggggtatggtcttaacatatatagacaggactatgattgctaacctcgctgtgggtatgggcttaactgctaaggcgcgcaaagagcggggcattagcagttggcgtggagtgcggcatgaccatctcacttccctgcttaatggcacttctacgcagaggcgtgacaagtacattaatatgctgaacaactactgccctggcatgctcggtcgggccgccctattctgggaacccatcagcaatgtgctggaggataagaactttggttcggttatggctaaatatggtcatatgtggggaccgctggcactaggctgcaaggcaatgggtcaaacgttccaggctgtaatgtcagacagcggcatcataccgagtctttctgagatagccagcgactatgactccatagatactaataagctggtgacactacacgccttcggtctgttgaatagttcaaatgtggcaggggctcattatgccacagtcaatagttacatcgatgatgttgatgcgatcaggtacacgatcgaagactttagcgcagacagatttgccatgatcacggacaggacatattttatcaaaataaataataccaaacattttggtcaatcggcgcgtactaagtctatgacgcgcggttctctgatgagaggtttcttcgatgacgacgaaagcgacgacgaaggggatgattactcgtcaccgggcgtgttagcacctagtctctcgctatcagagagggcgccatacagcagctccagcttacagtcagatacaaccataaagtctggtgttatcaagcgaggttcgcgcggttcgtccagccgatcagaccccagcgcttcaagcagccttgagatagttaacccaacagaccagctgttcagggaaatggatgatgacgagcagcagcgtgcatttgaccataatagtgaggcacgctcacctgacccggactcgtacgttgctagcgtgaagatggggtacaccggaccagctaggaagcctgacgcacctagcccgcagcgcggtaatggcgggggcgttaaaggccgcatacctgtccagagcccggctgacaagctgaggtttgacaaaatgtcgacgcctagggagatggaagatgctgccgaggcttttactatgctagccattcccgactctaacactgacggcatgactaacgcatttcacccacgcacaccaatgagcatccaggggtatgggttcaggactatgcgcactattgtcatgatgtataacctgctggccgatgaatcggctgacgagaagacacaaactgagaagcttgaaacgatgcttgcagacctgacttgtgacgctaacggggttacttatgtggcccttgccatagtcccaggcttcaatgcaattataaacggcatcatgaggagggctggacgattttcccggagggtcgaaggcgtcgcaagattactcttcagggtatgcaatctggcgccggaggggtgctggggcgtggtggtgcgttcagaaaccgcatcaggtttcaacttgggagcagcagagaccaaatatgcccttacgacgatgatgggtgcaggctggtctttgacaatgaagccagacatccgctttgaagttaatgaacattatgacattgggatgtacgccactatctcgcagaaggtggagccatttgttaggcctgaaccgaacgccgacaagaacagctcaggcagagtcgtaccgggcgaggtgactgagcagggctgggtggggcagtcgaacatgaagatggtcaaggagcttgttgctattggcaaggcatacaactatacaacatcatcaacactggcaggcgcactagaggcggcgcggggactgaacagggacattaagcgtgattgccttttcaggttcttcaattcgaagaatgaacaggtaccagtcattgtagtaccactggggcaggagctggagacattggcaactctgggcggtaagataggcgatgtatgtaaccaagcaatcgcgcttatcaagggacgttactctaaagaaaataaggagtctgatgatattgaggaagtgacgacgtcccagttgtttactgagctagcgcaagcggtggtgtcaaactactacggttcccacagggacgaaggtatcattttagtgccagggtacggcacattgaagaacctggtcggagatgatcatttcttcactaactacaccaacggagacaagcttttgagcgctgtgggcgaatgggagcacgaaattggcacgaagcattatattgcttcacgggatgacaatgctaagatggaggagtactacaggctagcgcttgagggtgataaggcaaatcttacagatacaaatgcaggccgcaaagtatttgacgagatgctgatggtgttgtctgaaagggcaaagacagacccaacacctaaaatgagtgcgaagcttgccgagcttaggaaggtgaaaacaggcgcaaagaagaagggcaaggcagtggtgagcaagggcacgaaacaacttatggccgcccataatgtcaaggagtaatggtaaagaaaggtaagaggagatattatattaaggcgacagatactgctgatgaagacagcgtaatggagagccgtattaagataaagttattatgcaatgaaaggtctcaagctgtagatggcggaacgtacagcaacggcgtggagcggtacaatggcatattctacgcggctgatagatattgggtggcagtgcctgtacttttagctaactgggtagtaggtagagtaccggcttcacagtgtgagttatatgaagcgcttgatattaggaaggtttacgaggaaacaatgaatacgctgttacacagatattcaataaagtcgcatttggctatagagaaatatataactgagaaacataacactgaagtaccccagatagtgataggtcacacttgcaatgtggggtcgcttggagtagcacataaaccaatgtgtttcagatcagccatgcaagagatgataagaagtggcaaagaagcgcgagtaactgtaatggtatgcaggcgcaatacaacaacaactgataagaaataatcagaatcgagagaacttatatacgggagagataaaaagaacattca

SEQ ID NO: 378 - DNA, 4228 bp, Unknown
  derived from dsRNAs of unknown virus
gaatattttaaactacataatgcagaacataattgagttacagaatgaacgagaacgtagtatcagagatcgacttcataccattaaagatcttgtgctggagacacaacgcgttgtgcgcccaggacaagataaagcgatggttgatgttggcaactcacaatttgacatgatgtcaaaggtggggacatacttcatgcaagtattgaaagatcacccagaagaaggtgaacgagcaatgttaatgattgaagagtggtcaaaacaagatcgcgcatcagaaaacgcaaacgttacaaagaacgacttcttcccatgcgtaattagatcaattaaggaaaaggaatttgacattttgcaacctccagctgtgctaacacaacatggcatggataaaatgttaagagctggtgtcggtggagagtacggagtaacgaaagaagatttcgagacctcattcttgcataacgtatccaagaacgaggtaacgatagtagaaaaaggatcctcgtgcgtagtaaatggtgtatcattgaagctaacaccaattgaagcaagatcaacggataagaaaccgccaattgacagtgacgtatcatatactgagtcatggattaataggtggggtgaggcgcgccgttacacacctttcacattaagctcaagttacgcaacatggattgaacttttccaacaaatgaacctagattggcctgaagctaaagcaaggggaggcttcccacttttagttggttgtttgtatcttgcgtgcgaatgggcgtgccgtaatggtggcgtactaaaaggcggagcaaagtcaccagatggcttcagctcaaatataatgcaagcgtggataaatggaaccgaagtaaagattccccaatggatgaacaagtggcgtcaacccatgtcatacgttagtacgacactagttgacgttggctatgaacctcttaagactcgggggttaatggagtggtcacgaggtgagctgtctcgcgaaataggtggcattgtaccatcggagacgcgaatgccattcgtagaacgctcagaaggaggctttccgttgcaagacgcagccctcacaacaatggggccacttcgaatgtttttgtgctttagcttggcgcttgagacaacaggatcatctcacttgaacgatcccgaagcaaacttttatggctttcaaaagtatatagaaggcgccctgctgtatttaggtaagcatcctggacaagtggggaggaaaatggataaagtggtcgtccagatgatgagattgctaagcgcggacctttcaatgaatgtaccagataacgtcattcctaagcaacagtttgatgacatcccatttgaagcaaacgtgcagcgcaatgtacgcctatttgacaattattcaatggcaatacttgctcacaatcatggcgtatctgtgaataaacatgagatagcaaaatcaatctgcgcacaaattcctgaaattgaagttggattgctcgagatattcgcagagtacagtggtgatgacgcagcgattcagaagtacaatgtatcaatgtacaacacacgtttgctagatgcaataacgcatcttactcaccctggtaacatggaagggtacagcagatcatgccatggatcattaccagttaaaggttataaatctaaaacccaacgtatcgtacttgagggaataaactcaagtgcgccacgtctggtggacaaatacgaggaggagctattcagagatatatttgatggttttattcctcccgacgcgaagggaatgtttgagcacatgtggtcactgtcaaattcacgatcaggtggtgcggataggattggatttaaatcaacgccgcaaaccattgtagatacggacatggccggacaatttgaggaaggatttgtatcgaacaggaaagatgtcatgcacttcactgcggcatttataatgaatgaaaaatccatgttaactagagctactcctgaaatgccttttccgctaggcttgcgatctgtggcggcacgtgtgcttcgttatatttataacttgccgataacgcagcaaataataatgcgtccaatatataagcatatcaaaaatcacatgctcaattcaccattaggatatgcaatcgagcagaagatcggagtggctgtagctgacatggcaaacgaaataaatacctctttgatgctagctcatgattctgggctagtatgcctggctcatgatgcgagcgcgcttgaccagcatattggctcaagacatagagaagtatggcgaaaggtgatgaacgaagtgctctcagattttgagaacgaaagcctgactgacatactaaaaagcgatgtaaagtatagagagcttgtggataatgtactgtcatcttgggatgacgcatatttcgagtttgcggtgccgcaagcaccatcacaattcctacatgcggatacccagccttctggagcaattaccacaggatccgataacacaatcactactatggcaatgctaaatatgattgaagcagaaacgggtgacgtaccaatagccaagcaagtatggggtgatgattgctactttgcaatgcaaatgcgatcaagcgatgatgtaatatctaaagtaaaacaacatgaggacctggccacaggtgcagggcaagtattgggaaccatcaaagactccacgagtggtagagtcgtgcattttctacaaaagttattcgtaggtggacaagtggtgtcccgtcgtatggcttatgatcatgagaacgcgcaaaaccacgaaaggctcccaggtatgattggtgaatatttagacaaggcgcgtgatttgtcaatgcgtggtgggaacctaaaattattgaacatgttacagttaatgactataattaatggatcaaggtctacagtgtatggaaggcaggcagttacttctttcgaaagtatgtccgcacccggtgggactaccaatagattactatttggattcggccaaccaaattcgaagctataccttgagttgaatttcccaaggattttcggcgacacgacggacatgacggttgatgcaaaagcagttctcgataccccaaaggaaattggcaagcgcgtaattaatgaacttactgataataaatcatcagttagaatgcaactaggtggaatggaagttaagagacctgatggtcaagactacacaatggatgagttacaattaactgcgtcagaaaggttgctaaagcgagagcgtcggcggaggattaatcttaagagctcattagttgattcttttacagaagctgacgtaatggaccatgattacgaacgcgctgtaattcgtggtggatacgacgccattggtggtatgctccgtgataagcgactaaatgccaaattcaaagaaaaagcgttagtcaagaacggattcatatcgtctagagccgacaaacaattcacaccagaagtaaaacaagttccagtaagcacgcatagaagtatacgaattggtgactcatacatcacatatacctttaacacaactcacgtcttatacttgccatcaaatagtgacgaacatttcgatctagcatctataaacggagtcatgtctcatagatataaacaacactggcatccattctacagcctccccgaaaatataagatatctactatcactaactggtatacatggtggtagggatagattgagaatcaaaacgcatgtaagtaagttctctccatctcattttagaaaagatttgatgcctgagcacgtaatgcatggaatcgatcgagtaagcaagcgcggtggaaacgtgcgagaatatcttaaatttgttggctttacatctatcggtgacaataacgaaattgacgaaataatgcgtcatgttcataaaatgggattgtatcgcgatctgtcggacgcggatgaattttcatcggtatttgatgtcgttaaatcggcctcaacgcaagtcgtaatcgacctgatctccagaacatcaccggcgctatacgccttgttatcaaccgtagactctgaagtacgtggagtcgttctaactcactatattggcctactatgcgacgaaatgaatgtagcgtgcgtgcagcatagatcgaatgcaagcggacgtaatttcattcgtgtgcctctagtgtcaatagacatggaaatctaataatttatgtagtttaaatgtaacatc

SEQ ID NO: 379 - DNA, 3972 bp, Unknown
  derived from dsRNAs of unknown virus
gggggggggctcacattgtgagacgctggtatgtttggacatttaagaccagcgttggtttctccgaaccattctaacaaatggtggaagtttgacgcattgtgcgtcgaatggtactgctaatagcgccacaacttcgttgtgtcgcaactgaaaagcgcatctcctggaaaagaacctttacggtcgcgcggaggttttaaatacatcgatttcgactagtgtctctcgtcttgatttattgcaccacacgacttgtcacgcacgttcaatgtgcaggcaagtttctgcttctctatttccctctttaaacagttcaaccgtcgctactgtagcgacgctctatggccactcgaatgtcacaccgtttagtggttcggcgatcgaagcggcatcgccagcaccagacggtcattggggccagttggctcagggcaatctgatcctgtcacattctgccaaattaatgctggagaaagcgcgtctatatttgtcgaccatgagttcttcgtcggttgacgacaaacactcgctatgcgacacgcaactctcgcggggctacgtcacaccacagacgattgatgattctttcatcgacctggatcaggtcgtagtcgatgaggattacgaggcttcgattgggtctggcaagtacttgcctggtcagataccaaccatccacacgcaaaggcgagacttatgccgcgttctaggcttttatgatgtgagtgtgcttgtcacagccaatgccgacttgttgtcagcccctaaacactcgcaccgcgacgtagtggacggtgattcctggtcgatgagctggcatgcttcaacgattgcaaccacagagatggccatcaaagttatgtccatctatggtggggtggccatcaggagaaaaacgtacggggccgccacattagcgctgatgcaaggggcatccccttcaagggtgccccttttggacagcgaaggcaatgtttgcgtcagacggtcaggcattgggctggaagggttgaaaaccgtggcctctacgttgagtctctgacaggtgtaacgccgtatgttagtaaaggacactgtcgcgactgatatgcgacgcgagtcgcatatacacatcgcgccattatgcatgaacctttctgccagcacagcctatgcgtttccgttgaccttgtaactgatggcggtttgcgcctgcacgagtgtacaactcaccattggtggcttgttgctgggatgacgttacattgccgtgtggtttaagtgtgacttcgtcacaatgaaaaatctcctctttcgatatgttgaccgacgtgtgatacattttccgatcgagaacataaagcgcgcctcctgaaattgaacccgcgtggtcgcgcggaggctatcatgacgattaatttcctgataaaacgtggatatcaactgttgttgaatctaaaatctctctgtttctctgtttccctgtttattatggcattgcttacgaacgccggtttgccatgtcgcgaccttcatgcattgttggccgacatcatttgggatgaccaactgtgcaccatatccgactcattagatgcgctgcgccagcatattgaagagtcagtgggcatgacggcacgatcaggtcgcaccctgaagttcaatgatgacgtgctagatgatagttcctgtattgtgcgcgctgatgacggtcaaggacgtacaatggctgtcatctatgcgcatgaataccagattagcgcacggcgactcattgggtggtcgaatttgcgcggcggttgggctcatttctcattaccgctgtattacactagtcaagagccacaatattgttgtagcgacacgtggaaatggaacaaaacctcctgcgtgtatactcagcatcagggccgattgaatagtcttttggcgcgaaaagcggtgtcgtataacccgttcgactacgtagtacacaactcgacggagcgtatgggaccattcgaagaagatgacatcgaactagaggtgcctgacgacttcgatttggggaaaagcgtgttagccaagttagatgatgtgaaacgtcagaccctacgccgcgcgcttggcgttggtcatggcatcgccgcctatgatcctgtcaccagcacacgcgtcattttgccagcgctgaacggcgccgactatgcccgtggtgagggttctctgcttccagtagtcttgcctgaatgtgagttgggtcagtttgccacttttgatgactctcgtgcgaacgctgtcagcgtttccatggggtttagcgaattcagccacatgcaagcagtgatatggactgaatctaacgctgatcaaccgaagcaggggctgcctcaacgcgtcagcttcagcggtgtgacgtcactcgccccggtttcccatgcttcggttttctggcgagcatgcgtccccggagtgtccaaccggctgcgggagttggtcaattgccacaactgggactccgtcaaaatgacgtatctcgtgaaatacgtcgcactcatcatagctcatttttggcgcatcttcatagagcactcgttgctgccggagccgaatgaacactcagccgttcatgcatcgttgaagcgtagaggttgggtggaaggacgctgggagactgatcttgaagctcccatcgagtttaaacgagaattttggggcaattgggacttagacggtgagaagttattcaccagactgcgcctaatgcccatgcgtgtggtcaagcatgcttttccgattgacgtgatggaaactggggccacagtcaccgtgaattctggtgatgggccagtcaacgtcaggatcgtggctcgtttgacgatggccactggcatgcttcaactactggaacaagatgggtcaatcaccgaatttgaatttaatgctacaccatacgagcggcccgggtgctatgcgtacttcctaatgccagtggacgattatggcgatgaacccaaattaacatgcccatcactacgggcagaagttgatgatgatgaaaaccgaaaggtcgcacgacctgcagtcaaggtgaaggctgatgcctcaggcgcacccggcgttacgcgcatgttcgcctataattcaacgtggcaatcacaggccccactcggatgggagcgacttacaagccggccagacgtcggtggaatgatacttaacattaaagagaaataccctagggacgccgtgctagtgctcagtttagagcgcgtgtgtggcaaagacctgcaggtggtcatgaaaggcatagcttggcaactaaacttaggtatgtcgcaccccaaatggttgcatgtattaaccgaggagcacgccttgcgagctctagctgatttctgttcgaccccattcgtcaccaccaacgagctaccgcacattgcgcacctggtcgacgaacctacataccctggattcaacatcgcgttcgttagatcgaactggagggaggctgcgcgcgctcaatgctacaatgagtgtcgctgtcagggacgctggacgccatttgccgtaacaacatctagagcaccggcgccgaaacgagctacgccacctgcttggctgacgggacttagtgtccctgccaatggttggtccgccgttcccggggcgaatttgtcagcaccggcatgtgcggttatggataaggctagagaatgtttcacaccaccacttcgtgcacagcggcacgggttcccaggcaggtgttgaggtttgagcgacagggttgccccaccgcgtgctagtgaacactggctgatcacccgtcaacaagctcatagtgggcttaattgtacatgtcgccttttgcgaaaatgcgtcaatgtactcacatacatataaggttcccatttatccttaaaatgggtagcgccatcattcccccaggggtgggtggccctacaagcgggtccgattgtgaccgctataaaaacaaaaaaaaaaaaaaaa

SEQ ID NO: 380 - DNA, 4227 bp, Unknown
  derived from dsRNAs of unknown virus
gaatactttaaactacataatgcagaacataattgagttacaaaatgaaagagagagagggattagagatagattgcatacgataaaagatctgattgaagagacgcaacagcgcgtgcgcccaggacaggggcaggcgatggttgatgtcggtaattcacaatttgatatgatggtcagagtaagcaaatatttcattaatgttttgaacgattatcccgaggatggcgagcgagctatgtccatgatcgaggaatggtcgaagcaagatagacatgctgacaattcgaacgtaactaaaaatgatttctttccttgtgtgattcgatcactcaaggaaaccgagtttaatgtatctcaaccaccagccgtactaacgcaacatggtatggataagatgttaagggctggattggatggagcacatggcgtatctaaagataatttctcaacgtcatttattcataatgtcaagaaaggtggcgtgacaatattagagaagggatcttcttgtataattaatggtgttgaattaaaactgacgccatcagaggcgcgctcaacggacactaaacctccaattgatagcgatgtatcctacactgaatcttgggttaatagatggggtgaagcacgtagatacacacctttcacgatgtgttcaagctacgcaacatggattgagttgtatcaacagatggatctggagtggccagaggcgaaagcaagaggtggatttagtttacttgttggatgtctatatttagcttgtgagtgggcctgtagaaacgggaccgtattaaagggtggcgcgaaatcagctgatggctttagtaagaatatcttacagtcatgggtggatggatcatcagttaaaattccacaatggatgaacgtctggcgtatgccaatggattatactacgacaactcttacagatgttggctatgaagctctaaaaactaaaggcctaatggaatggtcacgaggtgagttatctaaatcaattggtggaattgtgccagctgaaacgcgcatgccattcgtcgaaagatcagaaggtggattcccgcttcaggattctgctttaacaactatgggcccgttacgcatgttcttatgtttctcagtcgcgttagaaattactggatcatcacatcttgacgatcccagcacaaactttcatggtttcagtaactacttggaaggcgcgctactattccttggaaaacatccagggcaagttggaaggcaaatggacaaagtcgtggtgcaaatgatgcgccttttgagtgctgacctatctatgaatgttccttcgggaataatcgtgaaacaagagttcgatgacatgccttttgacacagaagtgcaaaggaacatgaggatttatgatcaatactcaatagcaatacttgcgcataatcataatgtacctccgaataagcagtcagtggctgaggcaataagtgcggttattccagaattaactacaggtttgatggagatctttacagagtacagtggaaacagcaacgccgccgataaatacaatgtttcaatgtataataccaagatgctggacgctataacgcacttgactcaccctggtaacattgaaggatatagtagatcgtgccatggttcgttgcctgtcaagggttataaatcaaagacgcaaagaatagtactggaagacataaattccagcgcaccaagattggttgataagtatgaggaggagctattctcaaatatatttgaaggttttataccaccagactcaaaaggaatgtttgataatatgtgggctttatcgaactcgcgttccggtggtgcagatagagttggctttaaggtttcaccccaagtaattctagattcagatctagctgggcaattcgatgaaggttttgtgtctaatcgaaaagatgtgatgcacttcactgcagcattcatcatgaacgaaacatcaatgatgacgagagctacaccagagagcccattccccttgggactacgatctgtggcagctcgcgtactgcgttacatttataacttgccaatcacgcaacagattataatgcgtcctatttataagcacataaaagactttatggctcactctgaggatggatacgctattgagcaaaagattggtgtagctgtggcggacatgtcgaatgaaatcaatacatcaatatcattaatacatgatccatccacggtgtgcctagcccatgatgctagcgctctagatcagcatatcgggtcgcgtcatcgagaaatatggcgtaaggtaatgtcagacgtactatcagattttgagagtgattcgttgtcgcaaatattgaactctgatgtaaagtatcgcgagctagttgataatgtgttatcttcctgggacgatgcttattttgaattcgctgttcctcaagcgccatcacaatttctacatgcggatacacaaccatcaggagcgataacaactggttcagataacaccattaccactatggcaatgctgaacatgattgaagccgaaactggagataaaccactagcaaagcaagtgtggggtgatgattgctactttgcaatgcaactacgatctgatgatgacataattacaaaaattaagcagcatgaagacttagccacaggggcgggtcaggtgttaggtactattaaagattcaacaagtggacgtgtcgtacactttcttcaaaaactattcataggtggacaggttgtctctcgtagaatggcatatgatcacgaaaacgcgcaaaaccacgaacgtcttccaggtctgattggtgaatacctcgataaaagtcgcgatctcgcaatgcgtggtggaaacctcgtcttactaaatatgcttcagttgatgaccgtgataaatggttcacgctcaactgtttttggaagacaggccgttacatcctttgaaagcattgccgcgccaggtggaacaactaacagattgctatttggctacggtcaaccaaattcgaaactctaccttgaactaaacttcccaaggatgtatggtgatacaacagggatgtacgtagattctaaagccgtactagatacgcctaaagaaatcggtaagcgggtaattgataaactgtcagaagaaaaggcatcagtgcgaatgcaattgggtggtatggagataaagcgtccagatggccaggattacacaatggatgagctacaacacactgcatctgaacgattactaaagagtgataggcgcaggcggatggggcttaatgaaaagactcgcattgcattaacagacgccgatgtcatggatcatgactacgagagagcggtaatccgtggtggctacgatgccattggcggtatgctacgagacaagagactaaattctaaatttaaagagaaagccttggttgctaacggattcatatcaagacattccgataagcagttcacgcctgaaataaaacaagctagtgttagtcaacatactggcatccgtgttggagacgcaactataaagtacagttttaatagtacacatgtcatgtacttaccgactaattcagacgagagctttgatctcatgtcgttatcaggcaccttggtgcaaagatataagcagtactggcatcctttctatagcttacccgaaaacataaggttccttctagcactaaccggcatacatggcggtagggatagactaaagataaagtctcatattaacaaattttcaccatcgcatttccgtaaagatctaatgccagagcacgtcatgcacggaattgatagagttaggaagaagggggggaatgttagagaatacctaaagtttacaggatttacgtcaactggcgacaataacgaaattgacgagataatgcgtcatattgataaaatggggctgtatcgtgatctttcggatgctgatgagttctcatcagtctttgatgtcgttaagtcatgctcaactcagcccgtcttggatctaatctcaagaacctcaccaactttctatacattattatcgaccgtcgactcagaagtgagaggcgtcgttttaactcattatattggcttactatgtgacgaaataaatgtagcgtgcgtgcaacacagatcgagtgcgaatccacgtaattttattcgtataccattagtatcaattgaaatgtctatctaataagtatgtagtttgaatgcaacatc

SEQ ID NO: 381 - DNA, 3330 bp, Unknown
  derived from dsRNAs of unknown virus
tgaactttaaaagactatggtagcagtatctgtgttaaaatgggtattccgcttctttatttacctaggtagataacgcgtgttcatcttatcaggtagctgatcaattctcatcgctagtttgttattgaatgggcaattcaataaacactgtggtgccgggggaacttggtagcatcgttaagtcgatgtcgtttatattaatatcttttattattttacgccggccaaaaattaaagaggataggcgtcattggcttgatatggcgcatgatgtgggaggtaatctaggaacgtacgggaaacccttgcgactgactagcgtcaactcatgtgacggtgtgatatattttcatatcttctgacaccatttgtcacaatgccttacaaatttagaaccagaatttaagcctaattctgttatttaaaatgaaatttaagtatcttacaagctcttttgaagttaatcttcctaataaagagaatgaaaatgattggattgtagttgtttctgaatcctcttcttataataaggaagaagttttagtcaatgcctttgaaaaggactttccagaaattaaattaattggaaatgatgttagtagtaaatacattttcctaactagtgttactgctcgttcaaaagctcttcttaaatggtatgctgcagcaaagctttcttattctgagttaacacaacttcctctttatctagctgatcatgttcatccttctgaatttatcaaagttagagagaaagctagtgaaattaatgtggttgtttcagaattctcaaagagagctcagtctttagctagagaatattctgaaaaacttaaaaaaattgaaaatgagagagatgaagctatatctgagataaagcttaacgataatttaattaaaatagtaactcttcaggttattgatttaccattatcaattcaaatgtcaattgaaggttatgctccaaaagacattagcagagatgtatctgaatcacgtcgtgtttatgctcgtgaatgtttaactactttcaaagtatctttacttaaactaattaatgatgaacctgaagttgacattaatgatattgttaaagaacttggtttaaagtaaaaaagattagtagtttaaaattactaagtgatcttaagaattacaataaaaaagaaagacgattaaagagtaaggtttgggcaccacattttaattcagtatcttatggaaagaataaacaaaatactgaatcgaaaaagaagtcaaaatctaattttaatcagattgttaataattttttaaaacaattaaattatactactcgtcgtttttcatatagatttgagaagaatcttagacgtactgttaagtcatatccaatttatagactcgttagaaaagatagaactattttaaagctttatagaagagtaaaattagatgattttaaaaagcattataatattaataaaactaatagagtagttggatggactccagaatacgttggtccttcacatagtaaagttgttaattcttataattatgtaaataattttatcactaaaaagtttgatgttattaaggaaaatgtatctgaatactgttttgatgacttaataaaatctgctgctgacgatagaatggtgtattcagctgggtatgatacatgtcatggtcatcttaaggaatactttaaagatgatgatattgaatcactttattttgatccaatagaaattattaaaatactagagttttctgattttagatggtttagagcaccagtatgtaattttaatgacgttcgtgagttgtttactatggttagaactaatctaaaagcattctcaggtcattatacttcacaattatttggaaaggaaaaattacattctgattttgcttctcgtaaaattgctagttcaatatatgagaacatgaaaaagtttccagttaaaaatttctatttatggtcaatattaggtagagaaaaagatattaaaactcatggtgatgaaagtgatgtgagtactagagttgttatgacttgtgagaatccaattgtaactctactgatgtggttcaatcagaaaatgtcttatattttatcctatggtgattggaatagaacatataatatagctggagaatttaataatgaaaaattttctaagttactaaaacatgaaaattattatgattttattctagaagctgactggagtttctacgattctaatattgatagtagcttcttattagttgctggtcttattatatgttctggtttacctgacgatcgtctccataggaatattagatacttaataatatctagtattattacaaaatatgttgtaatgccacctggtgttgtagttgagttgaatagagctcaaccttcaggtcatccatttggaacactgattaattgtaacgttaatttaatttattggtcaattataggttataagatatacggtaaagattatgcaaaatatatgcgagttgaagtatatggtgatgatactcgtgcatattttaagaatcacaaaaatctaaataacttagatcaatatgttaaggaatgtggtttaaaaagtgagattcttaaagacaactttagatctactcatgaattttcagaaaaaaatgagaatattgattttttaaaaagaagatttgatattgaaggtgttagatggaatcataaaaagatgtttgatagatggttatatcaaagcaaaaatagaaatattgatgaccagatattgttagtatcatcatattatgaatccgttccatcagacaatgacgtattaacattagttaagttattcactaagtttatgttagatgaatattcagataagttatcttatgatagcattaaattttgtgaaagctactcagagcataatcttaaaattaataatgtgagaaatgaaaagttcttttcatattataatagaacaaaccatagtatggagagttttaataaaataaatgataccttttcatattcttgtatgatttataaacctgaagaggttattgatcaaattatagttaggaatttgaatttagaaaaagttcttcattcattattcttttgtgccgaagatgttctaggtacaggaagatcaccaccatatgatccaatttctgattttgagattaaggaatttactaagtcctattggaatgacaagggaattgattctattaatttcttaaaaagaaaatttaatttaaaatagattataattattattattataaatatattattatgatactttgactcctcactacatagtgaggagttca

SEQ ID NO: 382 - DNA, 2071 bp, Unknown
  derived from dsRNAs of unknown virus
gtaaaaactaaattaaaatttaaaattttctagaaattgttattacatttctaaatgtgaacacatgtactctacttgtcgttctagttctcgacagagaggttgctctaagtgacactaaatagataaaacttacttatcaccattaatcttatggctaagaataatagtactaaccctaacagacggaagaagccacttcaaaatctaaacaataggacaagaacctttgttcagaaacaagcgaagaaggctccaagagtcgggaaggctataaaagatgttgctaatgttgcgaaagcaggtgcacaacttaacccaggtcaatttggagaaatggctgtcaatacatatcagcaatcacgaaaaggtaactatcctttaagtggtacttacaatgtaactgaagccatagtctctggagttggagaaagtgcagttgtatcttctaacaatttaatgcaattatggaaagacgtaggtattggtaaacctgagcaaggcagaagtacttcaggtacgtattctgacccttcttttactgctaatcgcgatagaagacaaggaccaactaactctaatcaatctaatccatcaacaaatatgccaaataggaaaagaggtggggacgcagatagttctcatccttcaagtcagtactccggtgatgccagttcggcacccattaatcctttcaacagttctgttttaacaggatcaccgattaaattaaattcatatatcgataaacagtatcagatgaatccttaccaggatcaagtcactgatattggtaataccgacgctgataattctagtcaatttaaacgcacgcacgttaatgttattgacacaacaaatggtgcactgtttaattttgaaggaaactcacgaatgaaagtctcattcaaccgtatcttccaagacttacgacaagaaatagttgctgaaatcaatgccaaccaattcactgacaaagtgtttacaaaggtaaatttcgatagctatatcaaaactgtctcagaagcttgggctttactggctgaacttcagactcgtaaaggttttgaatcatcatatgcagaacagaatttaattcttcgcggaatttctaactctatggcaggtaatgtcagcttattagttgcaatatcctcgcttgaaacaatactaaagaaatttgcccttccaattaaacttattgaatattacaaatggcttgctcaagtatataaatgtacacctgttgaaggtggaaaacactatatacaagccagtccgtacatgataagttcgcttcaccaagctagaggtggcttagatgattggactgatttaataattaagttagaagacataactgatgcattatactcgtcatcaacatttagcacaagtagtaacacaggtaactggtttacgctatctcaatatttagtgaaatacactagtactgggaactttacagatataggtaattgtatgtcttattgtactcaaccagtttacgatgttaatgctaatgcaatatgggataactgtgtatcatatcaaggtgtcagtgtagggactagtatgtttggtcgcttaagcataccaaacaacgaagatgcaatggtagctttcccacacgatgaagattgtgtgcctgcttacattacttctcatttattaccactttgggcaaacactgactttaccactggtagtggtcagacaggtggtttcccattctatggtacttacatgaaagatgttgcttctattcctgcggcagatcgtccaacgtggcaacctgaatcaaataatgtaatattatttacatcaggcaacagttggtcagttgatgttgttaacgaatcatgggattacattactgatcacatttggaccgttcaatacagctcaactggtgatagaacggctatgaacatgcctaaaggtatgaacactcgttactattcaccttcttatacaaacacaactacagcaagtgtaaacttaatgtatgatatgtttggtattccgttagattttggctaatgccagactggtacgtaagtaccagttc

SEQ ID NO: 383 - DNA, 3928 bp, Unknown
  derived from dsRNAs of unknown virus
gggggggggctcactatgtgagacgccggtagcttgtttgccggcgttaaggatccaaatggatgcatatttgttgtaaagagatatcgcctgatggcggcgcactccttgtaaaagaaccctggcgggtcgcgcaggagttttatgcttagcatacgaagattgtagggacgatcaacaccagttagcgactaaagtctgcaactctctttccctgtttccctgtttgtgaccatgtcacgattccctatttcgaggccagtgcctcggcctgtgcaagttggagtgagtttcgtgccgcatgaactgtccacgacggtttatgctgatcctcaaacttctctgttgcgaggcacggacgagcgaccagacgctccattcacggctctgttgatgacatatgagtgcaatcacggtggtcggtcgtccgattttatcaatcccagctccaacccgttggcgagcactaatgtcatgggcatattgttgacttatttcacagtcactttggtcgatgtcgtgagcggcctcggtactgagcttaaatcatctcagtctggtaaagctggccatatttacttggacaaggcaaccggggctgcactggcggcaagtggcgatccgcgttcagtacccatcggtggattcatcgatgctgtagcccattgtggttcatttagtaagactttctttgcatgtgccgtcgctggcaaccctgccatttttgcgccataccttaaaatgcgtgaagatgttctatcttatgcggctagcaccgattacgcacggtcaatacgcgactctgacagaggaagttccacgtcagaagagcgatctgtgcaaggtcagccagcgcgaacaacctctgaacccatgggtggggctccagcttcaagttctggtttgggggctatgaacgtaggctccgacgacgtcgcctttatgccagcgccggatgccgaccaaacaccagaagaagggggcgtcacgcttggcgctctagaaggtccagccatttcaggtgaggacgggatcacaatgatgctcgaacaattgggacacactagctctgtccaaattgcccaaccagtcgggggaatgtacgaagccgaaatggtgggcatgagtgagcaggcaagttcttcgacccggccggtcgccccatgcgtaagcattgaagaactgggcgcgggccgcgcgactgcggggtacgatgttagtgctgcaaacgcgccggaggatgtcgacccgcaaagcacacgggtcgcagacacgccaattggtcattcaactgcttcggcgtcgagttcggcccaggtgatggtcgaatgcatcgaaccgcgcgaggtgactacggatggggaagattctgaactgaacgaagaagagggggatgaagtagcagctgcgatggcaaggcaggctcgtgacggacgtaacatctatcgaactgcgttgcacgggttcaaagccgtggggcgcatttgctccccggtgggtgatggttccacctttatccccacacctttgcatggtgaacacgtcattaatgatgtgagaaagggcaataagcgtagacgcccaaagcagcacgtatccgaccctatcttgacgaacagaagtgcggtcattggcgaggaacctattaaaactgtgcccatgagcaagcagataaagcagatatggagcgcgatgacagaagccaagaaaacgcgacgacctattttggtggaagcggggacggccgcagggaaaacagcaatcgttgcagcgaccattcgatgttttgacgcgtactcccgtgtgatccaaactttgccgaaaaaagtcctggcagagcgccaatatgggtatgctaccaatcaacttctcaataaaaaggataatagcaccagagtcgccttcgcccatggtgatggcaacaaagggtatggcataaacaccaaattgctgcacgccacccctggctgggccaacgcttatttaggcagtgactgggggcggaaactgtcaacggatgattgtgactacctaattgttgatgaactgcatgaattcaatattaatgccgagtcgttgcttgagaggattgatcctgaaaactcgccaattatcattgggatgtctgccactatgccttcgcgattgtccacggtgttcgataacgccataaagatcaactgcgaagcgaccaactttcagaaaacgcgtgtcgccccacaaaaagggctggaatcgtgcttgcgcgcgatctatcacacacgcggtgaaaatctgactgattggacaaaactgggcgaagaattggccaaggctaacgctccccaatggacaggcgacgctttagtgtttgcaccaggggacgcagaaatagacgccatcatcaagggctttgaagattatacccctgagcgcacggtggcggtgaaagccacttccaaaacgttgctagaatctcccgaaggcgacaaacgctcaaggaggcgcttgattgtggctaccaatgtgctcgaatctggggaaacgctcccaatgctcagttgggtgattgtgcctggcattcatcgaacgccagctgtttcgcagtacgagggtgttcaacatactatcaacatgatcatatctagcgctagttatatccaacagatcggtcgtgcggcgcgcgtcaggccaggtttttacacaactgtgcttgatgacgccgagtttccatttggtgtggacgcgacccggcatctaacgaaagaagccctaatagcagtggctaccgctccttcgatgcaaaatgcgcgtttgctggggcgtttctaccctccgtttgacacccgaacggccgtggcggctaatgcttgggctagagcgaggatacttcacacgatatccgatgcaaaccacatggcagtcaagaaactaaggaaaactatgggtgactgcaaactcagcaaaggcagggaaatttgggctgaagcgtgtgctgctctaggatgcgtcggctcacttttcgccatgctcgcggccaccaatgtgacacaggagtttgagcagcgatttactctttgcgaagagggtcggttgacgttggtgggtgaacaacacgctttgtgcgatttcactgcgtcggcttaccttggactcccaaacaagaagaccgcagagcatttggccgaaaaatgcagtgcgcccactgctcggcgattcatcgatcgatatccacatgtgactgctatgaacaaattgtctagcggatcggggatcaacaggacgattgccgccgaattggcaatatggctgggtgtgatcactggagacataatcgtgtttgaccttgaccaggccgtcgtggattcgaaactatgtcgagcgcaaatattgacggcagagggtcttgtaaacatgccagtgcggatacaaagtgtcgtcaccttgcggaagcttcacgagaaacaagccaccaaggtggcagcacttatctcgcgggacggtaatgattacgtgacgaatcgaattgggccagctagcgatgcattggtatctgcgcacctcaacccggtgcgcgcaaacggacaacagtatctgcaagaattggcaactaggttggggtccgacacttttgacatggatcaaacacatgctctgatcaacgtcgaagaacgagtgatgtggcgccaagccagccgtgatgacagttgacttgttccccattgtttcgtgtttggccaagaacgcctaaccgtgcaatcaacacttatgtggttgtgcatggtgctagagatacgtaggacattgatcagcctacgcggtgatcaattacaagtcccagcttgtgtcctaaatctgggcagcgtcgtcattcctattaggtgggcgaccctgacagcgggtccgaacgtgaccgctataaaaataaaaaaaaaaaaaaaaaaaaaaa

SEQ ID NO: 384 - DNA, 1503 bp, Unknown
  derived from dsRNAs of unknown virus
gaatattattgaacattgtaaaattgttaggtaaataatgagcaggaatttagttaagcgttccataacagatggtggtaccaaattctcaactgcagattcgcgttatgtaaagcattcagcgcctacttcatctggcctgttatcaaaagttgcaaaagaagaaaagcgcatcgtaaaagaggcggaaaaagaaagacaacgaatcgaaagagagagacgaatacttgaagaggagaaaagaaaacgtgaactcgaagagagggagagaaaacgcaaactcgaagaggaggagagagaacgtgaagaggaggagagagaacgtgaagcgtttgaagcagcagcggcagcagccgcggctgagcaggcaagatttgacgccatcgcagaggctaataattcaattgacgctgacgggactacatcaacggatgataatgtttcaacttcagataagttaaacccgtttagcaaagcttccagagaaggaataaacgagtttcataaggatttattctcaggtggcggagctacaaactttcaagatgccatgacgtactatgagggtatagtttataagcttggaggtgttctcactattcctggaatgcctacggcggcaggagcacaccttgcaatgttgggagcagatttatcgcatgagctacgtacagccagcgcagatgattggaacccaactacagataaccgaacagaagatgagaagaacttcaacacacgactaggtgatagaattctacgtactatggacgtagttggcgctatactggatgggacaccaggagaaatatcaggaatccctggtttcgacaaagtgtcacaagatgacgataatcaagacttctttgggggcgtaggaaggagattcgaaacggtcggaaatagatttggaaatgactttacgagcatggagggcggtaaattcggctttaatgcgctttctaaatttgaaagtgagtcacaaagaataaagaatctacatggtattcgtgtaatcgaaagtgatcgatattatactgtaatgtatcatccctcaagtggcgttacatacatagaatggaagccaactgaggatatccgtaatataaagcaacgtaatagaatgtctagcgtgggacgtgaatggagtgaggacttcgttgccgcaatgggcattagaatcccggcatggtcaaagcgagtaagatacataaagggtaaatacggaatggaaagtgactctgtaaaacactatggatattcacgcggcggcggtctggcaacccatttaggtggcacaggatatggtactggttatttttcatcatatatgccagataaggaatctaaatccaagcttagtggtgatcgattgcatgaccttttaattaaccctatttcatacagcctcatgttgaggaatgtgctaaggaacagctgactcattttacttgaacgtgacgttctagccgtcacgatttatgctgttcagtatgaaacatc

SEQ ID NO: 385 - DNA, 1774 bp, Unknown
  derived from dsRNAs of unknown virus
ggtttaaaaattcattccacaccagtatctgcattcgcgatgtcaagaccaccaagatatttgtttgttgttgtcatgccttcgctctgtggtaaaagcacattagctcgtgatcatcctgatgtgtttttggatgtcgatgaattttacggcgatttgagaatgcgcgatttgcttatggctaaaagatttcaatttgatgatgagacgcatgatcgagacacacgtgtgatgcgacgaattgctctaaagtgtgatggatctaaaattctattagtgcatgctgaggttcagttggaacggattcaacgcacattgaatgaaatccatgttggcggcgtcaagggatattggccacattatagtaaggatcgtgaacgtatttggaatacggaagaacaagctgatttaccagcaagtgggacgggagtggcccagggggatgagctctttggccacgtcccgttgcatgtgataaatgcgggcacgtaccatctgaacctctgtgctttgggaagacgtatttggtcgttgcaccacacggtttgttgtaactatgatacggaactgaataagttgatgaagatgcatagactctgtgttgctatcaaccatactaaagagcatttgccaaatagcgttgaattgcatactgaagttgttgctgaacaaagtgatgaaacacctgaagatgcggcctcatctatggtaagtgaaattatagatgaagttgtaagtgaaactgatacacctgcggctacacaaatcatgacttatgctcttaaggtaataagtgaaatagcacagattggcatgggtcatgagggattacggtttccgcactacactatcgttagccgtcctgactgttggagtgctatgttcgtcgaggaaaatgctatcaatatggctgatgaaaacgttaaactactatcattgttgcgctccatccgtcggatgcgaactatcagtccaggaagctgtggttgtgacggattagatggtaggtgcactgaccctcaggtttgtaactattatggactctcattctacaagtcacatgagtcacggcaattagtccggcactatgatgatttcccattgatgcattgcgatgatagcccaaatttcgcgagtcatactagaggacagccccaaagtggttctgagatacgttctgaggtacgccctgttattgctgctaatactgaccgattcccgtggcttcattgcgctggagtaatggtgttttctatcagtttttggatatgtgtaaggataattagagacttctgccgtgattcagttgctagtgtttctgagtagacgttaagatgtgtttaaaacctattgaagcgataccgttccctccggtccgacgtatacgaccgcgttttgttcgcgttcatccattacggattattcgttattcgagctgtcgttgtgacgtgatcgatgatattgattgttgctggagagaaggaatcgccagaagatggtatatgatcgcgaattctcttagatacgtgtttgattctaaatttgtcacatttactttagttaacatcggtctaatggcttggattatattatatgactatttctataacgaagagatatgataatgacgaaagtgagaaaaaatcaaatggaggtcttggcgagctggctcgagttcaacatagagccagttcgagcatcagcgatgtggtagtgtgcgtggcgcggcgtgagcgtttccgcctagcgtcacggtctgtatgaatttcctacc

SEQ ID NO: 386 - DNA, 2038 bp, Unknown
  derived from dsRNAs of unknown virus
gtaaaaacattcttcggaaaacctttatccagtcccgtacactggtcttgctgacttccaatcagcttgaagagtacagtaattaacctaaacatgtaaccatgaatttacagacaaatcgtaaatcgagctttcctatgttacaacatagtcgaaaccgtagattatcaataatgcagtttactccacaaattggacgtaaacctagaatcactccaggcacaggagctcctttcgttaatccgggtagtgcaactacaccgacacctcagacttcaacttttgcctcaagtgaagctgggccgcaacaagatgcgcaaacagcgagagaaccaatgacagccgaaaagccgtcaaaacgtttacctacaacaaggaaacaaacagatatgaagactaaacgtcgttctaacaagaaagaaaatgactttatgtatgtcccaagaggtggtcgtcccagaaatgatgacaaacctgccgttaaattcacctccggtgatgaaattccatttggtgaacaaccattcagagacggcccagcaactataacaccatcaaaaccgatggggaaaattggggaactacccaatttactacaagaacaaattggttggaatacgtcagcacaagtaattaataatattagattcttaattcaagtagttgaaccagccttctttaatcaactgccttcgtcaataccaaacgcagctgatcaaagtttaaatagaaatcacgatagaattttcaacactctcttcaatcagatgagagaactatatcagagtaaattcaacattaacacggcttttgttaatgcatttacatatgaaaatgtgttcatctacttccatgatgttttcgcattacacgctgaattagtttgtttctatcaaagagcagcttattatcgaaatctagactctggaatggaaaacattctactagatcacgtagcaaatgtgctatctaacgatgattttgactctatccgtaacaagatggctcgagctcttagatttagttttcttccccaatcaattattgatgaaacttatgagatattccaaacatatcgattaggtaacccggtaacttcagggagtataatttttattactcctcacatgtcaaagttactactcgctcttagctcagcaactaatctagcttcgtataataccgctaagcaagtttacgagactgaaattgacgctatgatcgatcgagtgttaaatggtagacctaataataccactttagttgacggtatcccacgtagatggagaacgtctaacgcagctggcaacgactcaagtagtcaggacaactcagtttcactttatccagtaggacaaggcggacttagtcgccaaaatatgcaattcttaaatagtgttttcactcgaattgccccaatgtgtaatttaactatgttaaataaccagaagcgaggtaattcagagtcacactacataaacgagatttgtgatatattcaacaatcaaatgaatgttttcggtgcaggtacatacctgttcccaaaaatcgtttctgttggtaacaatcaagatatttcaccttcaaattttgagggagttatcttcgcatctgaaacagactcagagagtattacattcaagcaggttcatttccaagccgaacgtttcgctggaggtggacaattgctgttcagaacaagctcatcaactaatcttggtagccgtcaatatgcggttgagagagcccgaaaaccagatcttacagaatcgcaagatttaagatttgatcttcgtcaccattacacacaagtaagtaacaacgcacaatcatttgtgcaagacaactacgttactaaggtatttaagaaagagaataatacagaatttctatctgttaataacacagattcaacttctgcatctcaatggttcctgactttcggaaacctaatggacaaacagtatgaatatggagtggatttacttaagtaaattcaaggtttaacgttgtggatataatccacaaggttaatcct

SEQ ID NO: 387 - DNA, 1596 bp, Unknown
  derived from dsRNAs of unknown virus
gaattgaaatcccttcctacgataggaaataaggttaaataatcaagagagagatggactatgataatcgtatacgaccagtaaatgtaagagcacgtagtaggcgagcaggctttagagcagcaggagcgggctatgttagtcaatcgttaatgcgttttaaagtacatactgataaccacggtgtgggttatatgcgccttggattgagtgaaacccctgacggaagcgattcgtcgttagttgatagcttcgtatatcgtaataaaattgatgacttgtctataaaaatgaacatatctagcgatttggctacaatcgaagttgtcgatttatttatggaaatgcgtgatgaaatacaaccaggtcaagtgttcgaaaagtcggagatggataagttcagggggcgtgttgatctacaatcgatgatctgtaacaagattggctataaccactcttcagagtggtatggcgcgactctacgtaatgtgtttcataagcactcaccattaatccattacactgaaccgtgcctgtttgatttcattggtaacgaaatcgaaataacggaaacaaatagattgttacattatatgtcaacgccagaagatgtgaataatgtaaggcactcagataggataactgtatactctttgggtataaagataacgtttttctgcatgactacatcgtcacgtacaaggacggatcttgccgtaaatttaaacacaagttcaagccaagatttatctcaagcagtccaccatctacgtatggccgataaagtgacgattggtcaaggtagatcggaaagagttgtgccatttgtcatcgaaaatatggatctggatgacggtacagtggtaatgcatttatttaagagcgaacaaggcgttggtttagtggattggatggaatattgcgtagaccaacttgatggtcttctaaaatcactactaaatacactaacgacggagagagatactgcgtattactcacgcggacttggtgggagtttcccagctaatttctttagatcattacgtggtacaatcgcagcatacgtgaacgaaccatgggaaacaattgcccggttctctaacagtgtagacattcggagcattctaatcgcatatacaaccagtccaaatataagttcgctgccaatgagagaagcattatcgttcggtaataatgtgagaaatgtcgaaatgtttataaagcacctactgcgcttatgcatgaaatttgatacgttttacgacgttatcaattttaatgcaaccgacagaaatgtatatgataaacagcgacaattacgtgtgctagatgtgttagaaatgattagtaaaggttcatataacaagtatgttgacttacaagatgactcaatctttcaactcatgcgtaaaattaaacgcaaagaagaaaacgccacattagaaacagaacgatacataactgagtcagtaacgaaaatatccacctttctcaacgatgaataagaccttatatccacgactggtgaaaagtactgacaatacccctaaacccggatctatagtagggccggccgcggcaaaggatggtaacatc

SEQ ID NO: 388 - DNA, 1849 bp, Unknown
  derived from dsRNAs of unknown virus
ggtttaaaaactgagttggatagaagaagactgaataatgtcatgttcaaaacaagcaaagctctatgttacaacttcggagtcaaatactacattcaatttatcagacgttttttccggagccggtgagttattagatttacgagatgtgctgcagtcacagacttatttgaagaaagcgagtggaaagacgaacttatttggcgatggcgtttggcatcgatcgcgaatgtttaagattcgagattcaatagaatcgttgggcttggggttagcatgtgaagttgatgccagtggcctggattcatgtttgagactgatggcgacgtatcccgacatgccgccgctccttcgtcacatgttagtgattttttatctacgtccgaataataaaaatcgagatttgatggacaagttggggaaactatcagcaacggaattcgtggatgcagcagagccactgagtggattcatacgtatggaagcactttccatggatgatggggcaggtgtattgtgggctgatccatgtgagaatggtcgtcttgaagggtttgccactgacgggaaaagttttcgtgatgcaataaaaaagaaaagtagtaatacgatctcactcgtggtggttttccgatacggtgtagaccatgtctataacgtcggcggtcgctccgcacaacaaataacattgggatcaccatttatggagatgcatgttccccgcacttaccacgccgcttttctccgattgcaacgcggttatgcatgtattaaacgttgtgcaagtagagacaaagaattggcagtacgtactcacgtccgtcggctattcgagtatccgttccctgatggagtacgaattgttgagagggcgctggctgatgtcactaaattcttgaggggtcacgttgtaatgcaagatggtaaggccagtttccactattatgagtgtctacttgcggccggcaatacggacgaagctaacctcgggcaatttatgactgaagcattacgttgtgcttttagacactccggtaagtacaaagatatgggtatatgtccgtctagtcgcaccagcattacattataccagcgtggcaccgtattactatcggacgtactgtcatatggaaccgcaaccgccacaggtgtggtcgcacccgcccctgtgactaatggtaccgtagtgaccacgtcgggacaagcctccactgtctcgaacggaaagatacgtccatgggtacgaacaacacagcaaactgatttggcgaaacatcttgcgggcgttagtgacgggcaggtgaagaagagtgctgaagcgaacgacaatgtgaattcatcacaacaaactggtttgacaaaacatcttacgggcgttaataacgagcaagtggtgaagagtgttgaaatgaatggcaatgtggacgtaacctcaagtccattggctactgatactgccgcatccatagctccctcaccctctgaaactgtgtcacagtatgcgacacgggtgtacgacgcagcaccgcccacggatgatgacaaacttaagcccattcttgtgcgcctttggtctgagttaccatcaaaaggtcggacgaaactcgttagcaagctgacagatcaacaactgatggacacaggtacctacgtctacacgaacattttaccgaatgagataaagtctgccatcatgtatgcggtggtaaacgaacaaagtgcacgcgaaacacaacaacagaaatcagagcaataatgatatagggtcgacatgaaaggtctagcgagccagcaggagctgtgctctcttcccggattccaaccgacgcgttaactcgtgaagctgacc

SEQ ID NO: 389 - DNA, 3645 bp, Unknown
  derived from dsRNAs of unknown virus
tggaaaaatacccagttcgtttgcatgatgcaaattggtaaaacccgtcacagtcctgacgtaaacactggttcaacccgccgtaagggagagtgggcggagcatttcaactccgcatctttgtacgaaaactacacacaattcgagtctaatatcaacttcgctcgtgagcagctactcgcgattggatgttggcagcagattgaacgtgagagagcaaaaacatacccgaaagacctggtccctgaaactgcctcacaggagcttaagaggcaccatgaatcgtttgttatttcgtacattgccctcctcaagaagagtgagacgattactgagacaatcagtcgagtatccgaaaggatgcagggctcgatctcaggaatcaaagacgtctcatttccgacagaagaggagatcacgacagcaggagacatacctgtatcggtgatcgacctaaaggatactaccatccttgggacccacccacgcgccactaagaagtgggcacgccgagagctcaaagagtttcaggcaagcccaactccctggcagcttggagaagtcatttcccataaagagtggaacaagctgatgcatatcatgcatggcaacacaacacccgtccctggtgggccactactgaagtcagtggcaaaggtgatacccttgaaagaggcggctccagtgcggctcccacaggatgatcttcccgaagctgaagaagacagtgcggaggacggaaccatggaatcaatccgtaaggagatgatcaagaagctgaggagtggcgtggtcaggccatttcgtttgcaacctgtggtgaacaaggatacaggcgtaacctcctataaggcaccgaatacgcaggagtgcttgcgtcagtggagtgtctttcaggagatgtggtcggagtggtggattgctgcccaggtaatcactggcgaatacgtgagcccattcgacctttttccaagtagcttcactttcgcaaagcgagtggtgactcctgactatacgaacttactgtggcaaaacttcgtccctatgttggcagtcaagtcagacgatgatgactcatcactcgggtacaatgcaaataagggcattgacttgtacagtcaaggcattcattggatatttaaatcagagcttgagctcgtgatcgttctgctatcgatcttgctctccaaacctatcttactcacgcagaaggaggttctcgcgatggctactcagacgccgtcgatgatgaaggaggcaaagagtgtaatatctcagattaaaatgttcctctcaaagatcctgaatgcaaggactgctctgcgtgacccgagctatggtgcggtgaagaaggccttcagggaccggagaatgttactcgacgggcaaatgaaagccgtccgtgctcagctcaaaaagctggagaaggacatgtttcgtctgtcagttgatgaggacgaggagctggccaagctggacaggaataggaagcgtaccaaagtgtcaatggaggagcgactactttccatgggtctcaatggccttcctgtcgcagcggaggaccttcagaaaggtggcatacaaaacgtacctgagctagacgcagacgaatgtgatgaagagggttcagatgcgcgtgccctccgccaattgatgggtgaatagggtttttgctccgggttggaaatgggtagggtggatgaggctggggacagtgtaagtgttgtgtctagtttaatgagtgtgactgactcctcggcctctggtgtacgtaattacgattgggttgtaaagtatagggaatttaagggagtgcgctccgtgaaatcattaccacttcttgggtttcacggggcgtgcaaatacagttacatggagccgacgactattccttcgtctctgttccagtctttctacgctaaagcagagacttgcgcacttttatgggaggaatcccctgagggtatttggacaaaagaattccgtccacctagtgtcagcgatcttgcgatgcatttagagcgctttggtggggcgcgtgatttcaacactagtttcttcgacgcaaatgtgcgggaaactatgactaggatgtcccggattgagggggacctcccgacagtcctggttgacacgtggctcaccactgataatcttcttcgcgtccgggttccctcgaacacgtcagctggaattcgatggaaaaagaaacaattgcgagctaaagttgacgcactgccatacgcattagaagaggctgtcagggacatagttgggttgaaagaaggcaggccttatagcacacccccgtgcttttgtgccgctaggggtaagatagtagacatttttaaggggccggggaaaaaggaaggcagactcgtcttagttccagacctgaaaaggcatttgatgggttcgctcacatctgtaccatactcaaaattagtctcctccttctcaaagaagggtggaggtgtcctaatcggaatgggaaattaccacatgaactactcccaactggctgaggacattgcgggaattaagaagcctgtagcttacttgtgcgtggacttttctggatacgaccagactgtaccagctgaagtcattcaatggggtctcactagaatctcatctcgtttcaaaacctgccaggggagccatgcctactggaaatccgaactcaatcacctagtgcacactgaaattgcctttccaactggagaggtttacatgaagggcaggggtgttgcgagcggggatccatggacatctcagcttggcagtgaggcgaattggctaatgcaggaacttgcttttaggttccttgggtggaatgcgcgtgcatggacatttggggatgatgtaattgttgcaatagattgtctcccggaggggcgtccctctagtgcaacattattgacccagtatgcaacggcgatgggtaagttgtttggtttggaagttaagggttcagattcttactgtacacctcagctaagtatttcgggtcccgagccggttgaagggaagtctgtgaaattcttatctaatttcttcatggaggttggggtcatcgtacccgctccggagtttgcaaagactcttgagtcaatgatgtaccccgagtataatccctttacaaatgaacacactgaactgaagagttgggaagtggaagaattgctgagctttgagctcatgcgcacttcgtgcctgtatatcacgagctattggaatgaaagctcaaggcacctactagagcaataccacatctggttgctcaaccttcatgttcgcccaacccccattccaacctttaggctcatgcagcaactaactctctgggaccttgactggactactttcaacagtatctggttgacacacttacccagctatgctgatatcctgaaactgtacacttcaattccgcaacatgatagggtagacgtcggattggctagagctaagcttagcaggcttaccactttccagtcccggagcacatgagtttggggggagctacttcccctcgcgtccaacggccataaagacgataaaagtttggtcttgacgggaccaacgtaacaggatgagtgatagcagtagctcgtcaactggaacgttggagccccccgccct

SEQ ID NO: 390 - DNA, 1396 bp, Unknown
  derived from dsRNAs of unknown virus
cgtcaagaagacgtacaaactctaactgcggaacaacgtaagttcaaaggaaagtatgagtggtggtgcaccaaacactgcctccagcgcatctgcctcctcgggtaacgccagcatcaacgtcagccccgccgctgaaatgctcaacactctcgtcgcacgcaacttaacggcgagcgagatgcttgtgcactcgtccttcacgaaaggcatcatggctctcaccagaaacggtttgaccgaacacgccatccacaccgcaatccgcgagatcatcacgaacgatcgttctcgcatcgcccagcgcgtgaccatgcccaacgacaagggcggtcgcggtgtcaacctgtcattcccagcggcatgcagcatctcgatgttcatgaacctggacacgaagcacggaagcgggctcgttgctgccttcaccgccctggccgtcgagtggggcatcatcaacgaaggtgccgaactcgctcaagtcgacctccgtcggatgcgggctgccaacgagaacgccatgtacgacgccatggtcgcccaggccgatgcgtacaacgctaccgcccaagccgtcaagttcaacgtcactcgcatctccgttgccgatggagagaccatggcatctgagctcgacgccatctcagcgcaataccatcaattgccaggcagtgtccactcggccacagtcaaccacaggatcgaaaagtgccctgtcaccggccagcaggtgtacatcgcctacatcggtccgctcgaagccacccaccgcaacctcaaggtggccaagaagaaagtgaaaatcgcctatcacaattcaagccttggacagagcactgcaggtgactaacgccaaaactcatatctactagctaccgctgccacgcgacacagcagcgttagcgtgaacaggattcgatacacataagtctgacactatccacacgtctcgtctgtgtgtgtgcgtcccgactagtagtccacaaggtgtcatgacgccactgcagggcaacgagcaatccgtgccgcgcgatttaattcaaataaatcacgtttccacggagccaaccgcccctgtgtagcgccatagtacaccatgaactgccagttgtgactcatacacccagactcgtcgtcactggatggcatgtcgacatgttcggccacggcacgaccgaacactgtccacacgccttaatgcttgccaaccttctgactcgtctcttgtctttctcttctacattctctattcccgaccacaaaatttaaaacgcggcgagctcgtgcactgctgtttgacattcgtatgcccttgcatgcgagtgccacgctaatttcagcacccacgagcaagcgcaccgcaccatgcgtcccgcaccttcgaaagaaggccccc

SEQ ID NO: 391 - DNA, 2616 bp, Unknown
  derived from dsRNAs of unknown virus
gaatgaagaatgctagaatataaaataataatatactaagataacggagacaaaaagtatctttagttggtgaaactccactgttcccttttgggatttcgtgatgagtgagattgtaccctacgatgagacaatcactgaagaagaagctaacaacaaactgaagcaggaactagaggccttactcccaaatctacgtactagaagctttgatgatctatttcgtgctgctgtatttgaacttttcactgtatttgatgacatttccctagacacagatagtatctctgactcaataagaaatgcgtggtcagatctgaatttgagtaattcaccacttctagacagattcactgatctatttgatggcggacagatctttagagatagtttgggtgataacattggcagcagagtggcaactcattgtattcatgtacctaccggtactagacatgctactgacattaaacaacgtgaattacggaaacttctgcaattgcaactgagagctactgaaaacattaatgaccttcgccggaacaaacggctacgcgagcaaggaggtgttaatgataaaggtcagtttcaatacctaactttggaaggggcccgaatgccaagatacatcactccatcggaggcaaaccgcatgaccagctatgatgacgatagtgagtacttcatgcatactaactttagtagatacgaacgtaaagaacgtatgaggaaattcacagatgtgccaggtgaagttggttcatactcatactcggcagatgaagcacgtgatttcacaacgccaaagagcataagagtgaagtttgcaaagtcggaatcacagccgtttatccttcctatacttaagggttcacatgcagcttcgagactgacggattatggatatggtgataccgttgaagttcacttcttggatgaggtaatgattgctgaaatctcaggcgggcgtacggtgccaaatataaagaaagaacagcggaatccaggaaaaggaagctacactttacaattcaagataccaaatgccagtgtgaaatatgtaatgaagaatgcaagtgctggtcatggtaacagcagctcactaattctgacttcaaaacttgtactaagtgcatacgttacacctgctatgaagaagaagtgtagtttggtgaaatttataaacgagagtgaggaaccattagaattgcataacgcgttcataatgaccgtaatgcccctaatgacgttgaaaccgcaacatgaactaaaatcaaccagcttccctgtagctgcttcgtttaatgacgtcggtagcagtttaagcgtcttaatgctaaagtcaagttctgacgcacgtgattcactggagcttgcgaagtcatttaacaaggagttaagggagaccgagcaatggtctaacattaaatacacagagctactaagcatgtgcaaccttgtgtttaaaaagaacgttaaaaatcttggcaaaacattgcaggataaaatacgatcatcgaagtttataatgataacagagaatggtgttgaattcgaggatgtagaaaagattcgcgatcaacatcccatagttttcaaaatactgaaacgctttggcttaaacttactatggtatcaaagcacacgcacgttaactgaagaccgtaaacctgctttcgaggatatatacccaaaatgggaagaattcttcatatcatcttgcggtccaagtatcactcactccgaaaacattcgatcacctaacgaggaacatattggagcgaaaaccataaaaccagagatacttttagttaggctcgcgttatcacgtatattaaatgttggaattggaattagaaatgaacatagacctacgaacccaaatgctcgtacagtaccatttcatataacgaaccagaagagagccaacctttcaagtatacccttgtgtgtacttaaagacgagctattagtatataatctaactggctcgctaggcaagctttttgacggtgtgttcccaaccgacttctgctatgaagatcgacaaggtaacgtgggcgaatgcaggaatttaaggacaatagtttcaaattcccgtcatttacgaggagttaaatcaccgcaaatggcacttaacgctgctcacgttttattttccgtaacgtcgccattgattaaattgggtgtagatgatgacaccagcagcgttaaccctttacgtgtaatatctccctcaggtgatgaattcgatgtaagcctaattgcagaggaaacatgcaagaagcttctatcgagcgtggaaatgagaggcatggtcacaaaagatgagactgctattgtttggcacccgattttctgcatagtcgtcaacgtgactaagataagtaacggtagacttgtatgtgacgtacttgtaatgccatcaaaacgcgcttcgtccttatctacgtcgtaccataacactaatgacgtgctacgggagatggagtttaatcatgatgtgcgtgtccatttcgcaatgctaaacgataacctaggctatgctacaggtttgaatgcccatctccaaaacaactatttataacttccagatccacacattctcgaaacatc

SEQ ID NO: 392 - DNA, 1149 bp, Unknown
  derived from dsRNAs of unknown virus
ggtttaaaatccgtacggtcgacgatcttcgggctacttcaaacgacactgttagatatgtttttattagcggaggcgaaacgctacttatcacctgttgttggggtcactgaacaaactttggttgaaattgcaaaacgtgaagtgaacaggatcctcaatggttatagattatctgataaaggctggttggcgcatggctcacgagtgtattttctgttgttacgtgcagtcattgagccagagccgcatttagatggagcagtggttaacggtgatataggcaaacgaatacgcgagttgtttcgggattggtctatgttttcaggtggatcaggagctattcttggtttggctcatttagcgttggatagaactgtgcatcagacaagtgggctggttcgagcttcagattggaccaggtcgtatatcaaccatggtcctgtgaaaattgaattttgggaaggtaaactagatatgtatggtcatgtgaatgatcattggttggtggtgcgacacgcaaccaatgatcgttcgcttagattcgcgcgacatgattttacgtcatgcatgtcatctgtttcaggcgaggtgcatcctgctggtaagttgttacgtactgtcgagacaccatattcattcttcgctgttcagtcatttatgaattcggaattctgtcacaagcacttacctatgacaactgaagttgcatgcacacaagctatggagatgctggatggtacgagctggccacagatgggtaatcacaaattgaatgtaacggcaccagaactaggagatgcagatgctgacattgacggtacatggtttgctatggcgttcggcccaaccatagaccgatacctgccggtcttggaaggggcagtgtgtggcgttcgggccattaccgtgtttggacatcgaccatcactaatctcagttaacaataatcgacaattactaacatgggatcacaactttcgagttggtggaggcatcgcgggagaagaaataacagttagtaaggtcaagcagatacaaggatctcatttcgcaattagtgctaacgcagccatcttatcagtgtccgtattggggttcgaggagggttaagtcccccccgttagggagacatcatggagaactgac

SEQ ID NO: 393 - DNA, 1733 bp, Unknown
  derived from dsRNAs of unknown virus
ggtttaaaatatacgcaagtgaaacaatgcttttggtagatctattgaaccgtgttatcaacgatgcgttttccgctggaatagctgatgtactcaccgtgctggaaggtcaattctttactgtagatgatgttaccacggatgacattgaactgtttggacgtgcgatcttgggatcggccgctcgtcatgcattactcgaactaacgacggaggcaaaccgggtacgaacaacaaatgacgatgaagtgaactcgaagtggttctcaacttgtttcgatgacgttgtgatcgcagtttcaaaaggatggaaagaacgattggacttacagtttggggcgacacccacagaatgtgtccaggctatggatgattataaagagatcgttcgccgggttggaactactgtaccagcgcatcctttacagataccgcaaccaaccataggaaatcaagacttgatggatgcttggtgtcatgaccatgaccttcctcccgcgagacctggaacatgtgaatctaacttggtgtggataattaagcaggaattttcttcagacattacagaatccggagtacatatgtggatacataaacgagcagaattggcagcatcaattcgagtagcttacgcagaaaagacagctgaccacgttaagcgctggaccctgttacttatgccaattgatgacggtgctgcgaatcttgatgattatcaccgtggatacgtgactgccgtaagtgcggcggtgggtactcaacgtgttgaatttatggagcatttacgtgacagtttgactgttccgaatccgacgcccactccatacgcgccatatgtaccgatcgtactacaggacgacacatacaacgaactggtgcgcgatatgacgctcggctttgacagaacttcgatgtttgattgcataaaatgccgacctggtgggaatggacttcacagattaatgcgtcttgccctcaaccctactaacattgacgacataatatggtgcagaaccaccgccaaaactagaccactaactgggtactccgtgatacggtgtgttgagaaacggacgaatagtgctggtagagatccgcttcataatgtcgacatcagacctgtatatgtggggggaaatgatttaacgtttggaaagagccaattacgatatactgacctgtccccgggcaataaggtgttcatttctgtcaatgcgggagtgcctgaatatgttccttttacagttatggaagttcagaatgtatctcacaaatttaggaatcgtattactcggggcaggctatgtgacgtcgcaaacacgttattgcgaggttgggatgtaactgagttccggtgtcatatccaaactgggatgttgtcgttcagcttcacgggtgatgcgaaacttcaagtcatgcgaccaccgtcaccaccaccaatggcgggcggcggcatgggaggcgggagaaagaggaacatagcgaggacggatcatgaagaggattacgatgatgctgtcgatgatggaatgatgctattttgaattattgtcagaatatgatccggtgaataattgggcgagtacaaacaagaataagaatgagtgatggtaagtaacaagtatcacagtaagtgtaggtaggtaaacacatgtcatgggagaatcataaggtctaccaactgaggagtcacgtctttagcgcaagatgtgcagactcactatttactgacc

SEQ ID NO: 394 - DNA, 1432 bp, Unknown
  derived from dsRNAs of unknown virus
gaatattttgaagtaccatagtaacaaatacgaaataaaaatgattgaagcaggcatgataaacgcttttgctgatttgatgccagtgcacgctgaacaaaaagccgaacacgcttcccttgatcacgaaatgctaggtgcgcgacgagacgcagccgagtttgatgaaggcaggagcggattggacggattcgacaacattgtcgcatgtgtaaataatccaatggacaacactttaacgacagatggcgagaaattgttcaaaataattggtcatctacacacttttgttgatgaatcaattgagagatcagcagagttactaacatcaatcgaacttggagaagaaagagtgaaactaaatgccacgaagatgcgtgaagcaatgacgtacattaatgatgtccacgaacgtaggcttgagcttaatgcggaatatgacgctttatcaaaagctgattcggtggctcaacgagcaatgctacgatcagttatgtcagaaatcgaagatgcaaatgagctatcggacgttatgtcagagaagttcaaggatcacaagctggcaggtaaacaggctcaaatcactctggatactgaccgttttgaattagatggactgaggaaaatgaggataaaggaggtttttaatgcaaaagctttactattttcagatccaaaatggaagggaataccgagtgcagaaataaggctcagcccaagtgacaggaaaaccatgaagctagcctttgagaaacccttactgctgaaacttgaagcttttgacggaacaggaaaaggcaccaacactaccatgcttggagttgtatctaccccagtgagcgtattcactgaaacaattgcacaagatatggtcaggttcaagcaatctgagatcgcaaagaaagtcggaaacatatatactttgattaagtccttaacaaaaggtgaccataccagagttggatatgatgatgtcattttgactagatcaccagaaattgcggaggaaaatgcactgctcaatgaaatttatttcttaaatttaactgctatggctggatatgatcccacgagctgggcacaagcgtttggagtaccaattagtggaattggaaaacgaatcttgagtgaatgggatcatggccgtatgggaccgctaacgtcagaacgattgataaaattgtttgaacacaagtcttatgcgacaactctgtcccttaactacgaagaattagatcttaaattcatgaaagacgatataaaaatcgccagtgatgctaagaaggaaatccaaggtaaagataagggaggcagggaagaaagcttcgcgaggctagtcgccgaattcatccgaaatcctccaatggaagacggacgtgacggcgatgaagaacctgtggaataagaacatactatcttcaaatgaaacatc

SEQ ID NO: 395 - DNA, 2158 bp, Unknown
  derived from dsRNAs of unknown virus
cgtttaaataacgttaacgttgatattgtgagtaagtaaacttaaagtaaaaatggctcaaccctatgtgacaaatggtaggttccaccttgatttgaatccgatcactgtatgtttaaacagcgcgagcttcacgacggtgagacagatgtcgccagcgatcaaacaagtttatgccaattggataacgctggatgataatgatgaatgggtgcagttaggacgtgctgtgttgatgactcccggacatcttgccttctttggagggctggaacgattgccagtgcgcatgtcaactgaagattttctactaactggacgagatgtaggacgtcggctacgacagcatttattagtggatggtgtgacatgggtgggtgcggaattggaatctgtcgatcacttgcttaacacgggcgtgtccgcaaaattaactactagtgaaccgaaaccgcctcttgcactaatggaagcggcagatgtaacgaatttcagaacggaactggctaggttacgaccagcaatagatattgatccaagtctagatgccggccaacgtaagctgcgtgctatccacgatggattgatcagccggtcatggaaaatgatccttttaatcggaggttcgccagggacatggtggcgcagtcgacttgcagtgatacgaagagatacaaagttggttgtgtgggacccccgtcccttcgaaggggtacccccagaccatccaaatttaaccactgtcgactcactttgtgatgaagcgactttcctagctttttacaacaggttgcctcgtaagataaagagaaatatgttgatatctctagatattcgtcgagataaagaggaagtccgacggtctggtgctagttgggaggatgcggtcaacgccgatcaaattttgatgtgcagaatagcccaggcagcttgcagagaacgttcgtgggtgttattaaaagtgcgtccaatttacgactccgattacacaccaataatggatgctccattgctggctcagccctggatacatgaaaaatcgcatgaggcacggcagttagtccgcagcgaaacttcaatcattaacattcgtacgtcggacttcattatgcaagcatttgagtacaatgtggcacgtgaacaccaaccccttctcgatacattggtgcagaaacgatgggcatgggcgggaatagatctagtttcacgtcgatcatatctcaaggaccggcgtgctattggattgtattcgataagtaataggcagaacggaatccaggatatctgtaaatttattcgtagaggtggagtaatgaccatgcccttcgtctctttgttacggtcagagcgagatggtggcatatctgtattcgctgaaccaggacagtctgaacattacgaagaccacacgatggatgccgtcatgcaattcgagtttgaacaagcaatgattccagtgttcaacttcctggcacgtgtcgaaaccgccacacttaatcggcaatcattgactacagtaatttttgaaaagatgcgccagtaccaacagacagccagtaatccatcagcatggttagtgaagggcatatctgcagccctacggaagatacctccagcgactttatcttacgatctacgcctagacgctttcaactatccccggccaccctggtataactctaatgatctcatcggtcccggttttcgtgatcctacccgccctggaaaaaggccggtttgtgactatacggttaatggagagatacggttggtatcggggcatttgatgtacttgatgctcggtgaagcttccggaattcccgtgggaatgcgaaaatatttttctgagaaattatacaatgcgcgaacgcttgaagctggatatgaacgtggagacgatactttatggcatacagctgacgaagattggtatgcgacatatatagcggagcagttatggaaacatgttcttgaatactcaagtgtagatccaatgggtcctattgttgtgaggttctacgcttattcaagccgtgttcgccaattgatcattgaaacattggaacaggaacccttatatggagattcgagccgcctcacgcgcgctacgtgaggttaagcgtgcttatgagtggtattaaccagttattatcctacc

SEQ ID NO: 396 - DNA, 1575 bp, Unknown
  derived from dsRNAs of unknown virus
gaatattgcagcggtgtctataaatattatggaaattgcttccttctctcgatacagtgatggtgttaaaacaacttttaacgctcgaaaattgttacggactaggcagcgatcaatattaggtgcattcgtagtttcgaatgtaaagactaatattgatccaaatgccatcctaatgaagaaggagaacgcaagaatgttttcagtagatcgacaagatgtacaggaactaatgtcaagtagaagttatacgtatgacaaagcgattgcatattacgaagcagtgacccaaataccacaagcatcgaagaatttggaggcgtacacgaatcgacgacataaaccacctttaaacaacgtggtttcaaagattagtaagtcacctaagattgaatggtatgcgaactcatgggtaggaaactcatgggttaagaatatggagatgaaagatggtggaccaccttgtttttggactaaagaccatgaaaatatggatgatcctttcagtgtttcgtggaatgcatacaatgtaaagttcattaataggggaaggcgagtagcgtacgatacatatgatacatatgattcagtactagctgagttgcttgagtttattgatacgcattctgatgaagatgtcattcatgtatggatacagggtacattaaacggaaaagggccagtggcgcttgtttctcaattaaagcgcagtattgattcacttactgttaacgtacaagactctgaggtagccgacacgccaatgatttcaactggtaaacgtacgtctgagtatctatcgttatggactacgccaattgaacaatcacatgatatgtgggatttatatggcagtagaccaccaatgagaattccactcataccatggagagtaacgaacctgggcccacgcatatttaatgctgggaacccaccacaattatttccagcaactacgttcatgcgtaagatgggcatgccaaaagatatgctacaaattactgaagtatattgcaactacagtgagttcgtagagatgatacctttaacggcagatgatgctaatgtattagattttggctggatgctagtaggtgataacctgtataccatgagcctgataaatgaatcaaacattaagcatttgtacaaagtcaaagatcaagatttctttaatggattaggatcagtggtaacttctgcccatgcctgctttggcataggtagagcaaacaatgatttgataattcaattagagagaaaacaggctacggggcataccacttctggccatatgatagccagtgtgcttgccttccaaagccatttcttctggtatcttcaagaagtctacgacaacttttctagcggtaaaagcgtttacgcaaccaaattccttgaaccgggatctggagcgtaccactcgatacacgagtataggaatgcaatctatgatatgaaacgagccgacgctaacaagatatacccaagatatgctagaactaatctggaggtatgcataaagttcgtcagcttgctaaaagtatagatagggaacaacgctacatgaacatc

SEQ ID NO: 397 - DNA, 1700 bp, Unknown
  derived from dsRNAs of unknown virus
gtataaaatttatacaccaataaaattattaaattatcatatttattatggataaaataaaactgatgcaagaaagcatcgacgtcttccttaccccagaaggtcaagtgcgtgcttccagcggttttcgtgctctagctttaggtaggcctcctaccccacgaactcctctttttaaagaccaagatcccgacgagatactctcaaattggttggatgttctggacctagtgtacgatggtaatccagaccttcgacctctaattgattacgataagtcccgaaaaacaaaattcggaccacaaggtggcttacgtcctttcgatgaacgtgaagaggatttcgacgcatattatactacaccggatcgacgcgattccagtgctagaaataaaattgtagaatggctggataattcagggatactcggtcatgcgtctgccatatgctttggtaccgcaaatgagttgaacaagcgaccattacaactggaaactgtagttaaaatggaccaactcgacgacaaacttaattccaattcaggatgtcgtgattatgcgagtcgaacagatccagctgttcaggctaatgcaatcgaagctgttaaagatgggacttgggtgaacctaccaatgattctcggctcccgttctcagcgcggatctgaacgtttcatttttatggctccattctccctgaatatagttgaaaaaacttatctctaccctcttatgcaacaaattcgtgaaaatggcgatcccttttttagcgcatgggaaggattctccgaagttgaacttggtttcaaaaatcagaatttcttctcagaggagtacacctatattcagcaagactttactaaaatggacaaacattttaatctgctacaaatgtccattgtattctctgtttgttggaatgttttccaatcagagcctagaaagtctttcaaatccctattacgtcatatcctagaaataccagttcttgtcagcctagacaaagcggctaccggattacacggaatgccttccggttcaggaatgaccaattttgcagagagtattgtctcattagttataattctaacataccgtgcctccggtttagatgttgtagcttgtcaaggccttggtgacgattcagtcatggctataagacggggcaaattcttagatgaagagatactggaattaatggaatctactgccgacctgtttggacaaacagtaaatccggaaaaacaaggcattagtgaacacacgacagtctacctacaacgattctttgacgacagaatccccaatcatggaatcgttttaggtatgtatcccagtatacttgctttaaatactgcgatcttcccagagagatatcacgatcctcgaaaatggagtaaagagatggaaatactccgatggattatgattttagaaaactgtaagaatctaccttatttctacaaactagttcttttctttatggaaggagacaagtatcaattgggtcttgctctccctgatttcttcgtaatgttaccagatctatacgaagagtctaaggctattaaaggtttcgttccaacttacaatcaggaaagtatggatagaggaatttatgactttacaacggtcaagcttcttctagaaattgcgagcatgcgcaaataacgcctgggtcatgatttccatcatggccac

SEQ ID NO: 398 - DNA, 1132 bp, Unknown
  derived from dsRNAs of unknown virus
gaatattctcagacgcaatatatattaatatagaatgcagtattattcagctagtgataacgcaccaaagaatcgtcaatataatgaccgcaatgaaagacgacgtccacaatacgctgtagatcttactaagaagtacgaatcagaagaaagatcgaaaaatcacgacatggaaatgtctgaaatgcgtatgatgttggacaagctaactgctggtaaggagcccattccaatgtacttcgatccgaaagaccttgccaacggaacctatggagtgcatgtggataagtatctggggcgcagcccttgtgatggtcccgctgggtacatctttcagaaggtaacttactcagctggtgctgcaagctcaaaaacgaatgtggctggtatgtacaagctttcaccagatcatttgggctacattttccatgatgacgaaaataccacagaaatccgaataaatcatgatggagttgactctgcaggaagtaatgatccagcaccaagtagcacagtcattacgaatatgggagaggcgaaactcgtctcaggtgatatggtactaggagcaattctacaactagttgataccaggtcatctgataatagaactggtttcgtgactgcaggactagtttccaatgattcggcagttcctaacacgtatggcccagaattatcagatgacccaagcaatttcataactggtagtgcaatcagtggtgggaggactcatgctgcaaacgggctacttgcttgttcagtagctagtccaaacttgaacatttacagcccaactatcctatctacattaactggtgatctagctcctgcttcgattggagcaccgatcaacgctatcaatgtatctggttgcactggcactgattcaggccaagttagatttgttttaaacatatacgcactagtgggtgcacgacagaaaactatttcacactacactcaagccgacccatcttttaaaatggagtgcctaactaggcaatttgcagaacatccagtttctatggtgcattaaaattactaatagcataagctacatcatatattaatctatacagcctcaaatgcggtatgtcaagccgggttcacattaatgagatgaaacatc

SEQ ID NO: 399 - DNA, 2433 bp, Unknown
  derived from dsRNAs of unknown virus
gaataatgagtgcctaagtagaaacaatcaagatagtgtggttgtacattccgtaaggacctagaatacgctgaatctcagccaaatcatccaggatccaaagaatgaacacgatcactactactatcacacaaaatgatactttagtaattcaacagcaaagttctttaactttagttcgagatgccttcctaagcataggcttagtatttgagcatgagagctttggaaatgaacttgctgtacaaaccgcgtatcaagaatcagaaatgacgcaaacgcaaaggcagacgcttcgtgacatagtcatgagtggtgagctttttcatagcgtagaagatcttggtacacgtgttgccacgtttacaattaatccattaactggtcaatcaagaggcaggcttttatctgaaaacgcgcggcttactttgatgaggaatgagagagtgtgggataacacgttatctgacgtcaggtcgaacgcctttctaagagagcaggctgacatggaggatggtagattcacctatagaacgcttaaaggtgcgcgttttccaacaattgtcgatcgtgacatgttaagtacgctttcgagtgaagaaagcgctggtgattatcaatcatatactgatttcagtaactggatggagccaagaagttttaaatcatactctctgccatctgatgttgaatattcgactagcgcagatgactcgcaagcagtatacgcacaacgtgaagtacgcctcaagttcaacacatcaacattggacgttaaaggccatgctgtaaaaagactcgtgtcgtatggatatgattgcaccgaaataaccttaagttcgcaagtcgtaactgcgaccatttcaggtggacgctgcgtcccaaactggtcgcaagagcgcccacaattaagaaacagccaagtacgttataagatgacatttgagcttaatgatgtagatgtaatgctttcaagtaacgaaaaagcgaaatgcaaagtaattataagtgcttacatcgcacctaagattggtaaaaagaaagtatcactttctgagtacctatccaatggcgaagaaccgctagagataatcaatccattcgtaataactgttattctgttaacagtccctggatctgactatcgtctacgcgcaacaggtatgcctgttataccagctggcgttgactttggagatacttcaaagccagtcgcctttattaaatcatcgtcagacgacgttaatttcgatgatatgttaaatgattttacgaataaattacgtaggactgaccaatggttaaatgttagacggcaggacattaaagaattctgtgaccgatctccattcttctcatccatgtacgcggatgagaaatactcccacataactaaatgtggtgtggaattcgccgacgttgaatacattcgtgaaacctaccctagacttttctccggactgttaagcgttggacatacgctgatgatgaacaaaattaacaaaggaagatctgaagcagatctttcccttacagagatcaagagagtttggaaatattattttgaaactagtagcggaccaagcatcgtacattctgaggatattcgatcacctgatgaggtggcttacggggttaaacctgtagatgagtccttactcttagtgagaattgtactttcacgtatcttgattgtcggcattggagatgttaatacacatgacccaaacaacccgaaaactatgccaatgtcacatcatcttctaaaccagaagagagttgaggcaatgttaatccccttaagtgtaatgcaagatggccttttaacatattccgtcactggctctgttggaaaattgcttaaagacgttacccgtaataatcttgctggtagcacattattcgatataatcaagagcagtggcgtaaaacgtaaagatcatcttaatataatagatgaattgaccacacaagcgctattcactgttcgagctccaatcttgcaagttgatcagaataactccgcaatgggcgatttatggtttgtctctccttctggtatggaattcgacgtaactccgatagctaatgagatctgttctaagttatcgcaggaaacgctattcagtgaagctgatagatcggtgatcgcgtggcatccactattttctataatagtggggaaaacgcatcgcgaaggtggtagttttagatacgacgtcattttactgcctgcaaagcgtaagtcatctatggctgtgtcataccacaattcaacggaggtagtgcgtgcgcttgatttcaataatgaagttaagattcactatgctacattacgtgacggcggcggctatctgtcggcgttacgcaccttcattgaagatcccaatgcaatgtctacatgatttaggatccacacactcaggaaacatc

SEQ ID NO: 400 - DNA, 2006 bp, Unknown
  derived from dsRNAs of unknown virus
gtaaatacagactttcgtctattttattcgttttaggacttccgatttcctataacttccaattttaggaataaataaaatccgtaattaacctacattaacctatgtataacttaaatacaaacagtcttcgtaatagaagaacttcggtggtaactaattataatataccaccccgcggtccttcaggacctcttccgatactaaatcctttacctggtgatgtttctcaaccaacaacaggcagtccaattcctggacaaggaaattctggttttagagtaccaaatcaagcaggtagcactcctgccaattcaggtggtacttctagcagtcctagttcgaatcctaaaccacaaacggtttcgctacctcaggacaagaaagccaagaaaactaaacagaagagcaagcgtaaaacaacaagatcgttgaaccccttattacctagcagtgatagacctgaacttttaaagtttacaggaggggacagatcaccaacaggagatatgccttacagggatggtccagcggtattcacacccgaccgcccttttggtaaaataagtgaattgccaaatgcagggcagttcattcaaccatgggactcgccagctgatgttatgagtaatgtcagaactctggtccaaatcatatcagcggtatggtttccgcagttcccatcacaaaagagcggagctaatgatcagaatttgaacaaaaatcaggaaaacatattcttgactatgttcaaccaaattcgctacatttatcaggagagatttaatatcaatcttggttttacagaagcatttactgttagtaatgtttttgtgtactttttcgatgttcacgcattacacgcggaattagtttgccttcttcagcgagctgcttactatcgcaactataatgccggcatggagaatttagttcttgacaaccttgcatgcattcttaataacattgacatagattccgttcgtaatagaatggctagagctcttcggtttagctacttaccaaagtcagttatcgatgagacttacgaaacgtttcaatcgtatcgtatgagtggactagttacttcaccatctactatctacgttactaagaacatgggtactttaatgactgacttaggtgctgctactactttagatgagtacactaaggccgtaaaagattactctgatgctattgacattctaatttcaagagttgtcgatggtagacccgcaaacacaagttcaagcactggtatacaacgttactggaactggtctaacaatgtaggtgcctactctcaaggaaacgctaacgtattcgaaataggtgatagtggtcttacactaagtcaccagattatgttaaacagcgtctttgctcgcgtagcacctcatactaatctaacgctacttaacaatgtcatggagggaaattctcgttccgaaattgacgttaactttaacgacaggtttaataatcaacttacattggctacaagtaattttgtaatgccaaagattcaaggtggagcaactatcaaagatgctcctaagcccgctaccgctgttgcatttgcatcagatagacgagctgaagaggtatcatacaaatcagttatgtaccaaagcgagaagttctccggtggtggagctctattcttctcgactgatagacctggtaccctgtggtctagaatctaccttaaagagcgtgctccagtttctggattacaacctgaacaggatgtaagattcactactgtgagtcactacactcgtgtaattgataacacttatcctttcgtgcaagataattacgtggcaaaagcctttacctctaatggtactaactggcactacgcgcagaatacggattccaattccgctgctatgtggtttgtcacattcggtgatcttatggagcagcaataccaacacggtattgacatccttaagtaatacaaaggttaacctctctcctgagagtaggttaacccc

SEQ ID NO: 401 - DNA, 1567 bp, Unknown
  derived from dsRNAs of unknown virus
gaatattattgtacattgtaaaactgttaagaggaaaatgggtcgaaatctagtaaagcgttcaattactgatggagggacaaagtactcaaccagagattcaagtggagtcgttcactcagcaccgacggcaggcagattatcatcaaacgtcgtcaaggaggagaagcggaagatagaagagagaataaggcttgagaaattgaggcttgaagcaaaaagacgtgaagaagaaaggcttgaggcggaaaggctcgaaagaaagagacttgaagaagcggagcttgaggcggaaaggctcgaaaaagagaggctcgaagaagaggaaaggctcgaaaaagagaggctcgaaaaagagaggcttgagaaggaagaacgtgaatcagaagaagccaatgatagagaacgagaaatcgacaaagataacttcaacaaagatatcaacaacgcagatccgccacctgaagagggggatggaggctcgtcttcagataaatggaacccgttcagcaaggcttccctggagggaataaatgacctacatctggatctattctctggtggtggagctacaaacttccaagacgccatgacatattacgagggcatagtttacaaactcggtggcgtactttctctacccggtatgccaacagcgcctgcagcgcaccttgcaatgcttggggcggatctttcacatgaattacgaacagcaagtgcagatgactggaacccaactacagataatcgaacggaagatgaaaagaacttcaatactcgactaggtgatagaatcctacgtaccatggatgtggtcggtgcattactagacggaacgccacaagaaattgcaggaattcctggcttcgacaaggtctcacaagatgatgacaatgaagatttctttggtggtgtcggaaagagatttgaaacacttggaaataaatctttagaaaagttaatgaaaagcaagacagctaaaaatattgtattcggatttgattcgggtatatttaacgcactatcaaagtttgaaactgagtcacaaagaataagaagcctacacggcattcgcgtaatagaaagcgatcgatattatagtgtgatgtatcatccatctagtggaataacatatgtagagtggaatcccacgacagacgtgcgtaacgtgatacgtcgcgataagcgatcagatgttggacgtgagtggagtgaagacttcattgctgccttagggattaaaataccagcatggtcaaagcgagtgaaatatattaaggataaatatgggatggaaagtgatgttgttaaacattacggttattcacgtgggggaggcctagctacacacatgggtggtattggttatggtactggatacttttcgtcctacatgcctgctaagggatcaaaatctaagtttagtggtgataaaatgcatgactacgttatcaatccaatttcatacggtttattgttgcgacacctactaagtaaaagttgactcattacacttaaacatgatgttctagccatcatgacttacaatgttcgatatgaaaacatc

SEQ ID NO: 402 - DNA, 4227 bp, Unknown
  derived from dsRNAs of unknown virus
gaatatttttagctatataatgaagaacataattgagttacaaaatgagagagagagagggatcagaaatagattgcacacaatcaaagatttggttgaaggagtgcaagataaagtgagacctacaaataagagtgcgatggttgacgttggtaattcgcaatttgacatgatggctgaggttgggagatattttgtaaaagtattgaaagacaatccatccgatggtgagagagcgatgaaactaatagagcaatggtcgatacaagatagggatggtgataacctgaacttaactaaaaacgatttctttccgtgtgttattagatctgagaaagagagcgatttcaaccttggtcagcctccagctgtattaacccagcatggtatggacaagatgcttagagctggagttgatggctcgtcaggtgtgacatctgaagatttcgaatcatcatttattcataatgtaaagaaaggtgacgttatactgacagtacctggagagaaatgcgtgataaataaagtggaattagtgctaactccttctggagcaagatcaactgatgttaagccaccaacggatagtgacatttcttacacagagtcatggattaatcgatggggcgaggcccgacgtttcacgccttttacgctgagttctagctatgctacatgggtggatctttttgagaagatggacttatcatgggaggaggctaagtcacgtggtggtttctgtcttcttgtgggatgtctgtacttatcatgcgaatgggcttgcagaaatggaaccgctttaaaagcgacgtcaaagtccgatgatggcttcagttcggacatactaaacgcatggatcaatggatcatcagtaaagataccgcaatggatgaataagtggcgtcagccaatgcagtacacaactactactttagtggacgttggttatgagcctctaaagacaaaaggacttatggagtggtctcgtggtgaactatcaaaatcaattggtggtgtgataccagccgagacgcgcatgccctttgtcgaacgttcggagggtggtttcccactacaagatgcagcgctaactacgatgggcccattacgtttcttcctatgctttagtttagcgttggaaacgactggttcatcacaccttgatgatttatctactggtaatgatggtttcagaacatacctggaaggagcgttaacatacttaggtaagcatcctggtcaagtgggtaggaagatggacaaagtggtagttcagatgatgcgactaattacagccgatctatcgatgaatataccagaccaacttttagtcaagcagcaattggatgattcaccgcatgattgcaacgtacaacgtaatgttagaatgtatgacagatacgcaatagcaatcctcgcaaagaatcatgacgtaccatccgataaacttgcgattgcaaagtcaatctcatcaaagatacccgagcttgaagatggtttgatgaaaatatttacagagttctgtggcagtgatgaatctgtaaataaatacaatgtatccatgtataatactaaggtgttagatgtaattacgcatctaacacaccctggtaatatggagggttatagcagatcatgtcatggatctctacctgttaaaggttacaagtctaagacgcagaggattgtattggaaggcattaactcaagcgcgcctagattggtagataagtatgaagacgagcttttcagggaaatatttgatggattcatacccccagattcgaaaggcatgtttgaaaacatgtggtcgctatcgaactcgcgttccggtggcgcggatcgaattggtttcaaagtttcacctcaaactatcctagattcagagttaggtggtcaattcgaagaaggttttgtatcaaacaggaaagatgtaatgcattttactgcagcattcatcatgaatgtacaatcgatgatgaccagggcaactcctgacatgcccttccccttaggcctaagatcagtcgctgctcgtgtattacgttacatttataaccttcccatcacccaacagattattatgagacctttgtacaagcatatcaagaactttatggcgcattcggaagatggttacgccatcgaacaaaagattggtgtagcggttgctgacatggcaaatgagcttaacggttcgataatgttatcgcaggatcctaaccttgtgtgtctggctcatgatgctagcgcactagatcagcacattgggccaagacatagagaggtatggcgcaacgttatgaaagaggtgctcgttgagtttgaaaatgactcattgcgagatatacttggttctgacgtaaagtatgcggacttggttgataacgtgttatcatcttgggatgatgcctacttcgaatttgcagtgcctcaagccccgtctcagttcttgaatgtggatacgcaaccctccggtgcgattacgactggttcagataacactattacaaccatggccatgttaaatatgatacaagccgagacaggcgatgtgccactactaaagcaagtatggggtgatgattgttatttcatgatgcaaatgcgtggtgatgatgacatcatagagaaggttaagcaacatgaggatttggcgactgaagctggccaggtgttaggtactatcaaagattccacaagtggaagagtagtgcatttcttacaaaagctgtttgtggggggacaagtcgtttcccgtagaatggcatatgaccacgagaacgcacaaaaccatgagagactcccaggtatgataggcgagtacatggataaggcgcgtgatatgtctatgcgtggaggtaatttagtattacttaacatgttacaactgatgacgattattaacggttctaggtcaaccgtattcggtaggcaggctgttacgtcttttgaaagtatggccgccccaggtggcactactaatcgcctaatgtttggattcggtcaaccgaactctaagttatacttagaactgaacttcccaaagatcttcggtgatgttacagatatgacggttgatgcaaaagcagtgcttgatacacctaaagaaatcggcaaacgtgtaattgacgagcttacggataacgaggcacatgtgcgtttacaactaggaggtatggaaattaaacgcccagatggtatgtcatacacgatgaacgaactgcagagctctgcgtcacagaggttactgaaacgggatcgcagacgacgcggtagattgactggtaaactaacagattcattcaccgaagccgacgtcctggatcatgattacgaacgcgcggtaattagaggtgggtacgatgcgattggtggcatgttgagggagaagcgattaaactcgaaattcaaagaaaaagcattagtaaagaatggtttcatatcccgaattgcagataaaagtttccaacctgagattaagcaaattgccgttagtcaacataggggtattcgaattggtgacgctgttgtaacctatagtttcaacagcacacatattttgatgctaccaaacaacagtgatgagcattttgatttgcaatcacttgatggtactctaacgcatagatacaagcagtactggcacccgttctacagttaccccgataatataagatatttattatcactaactggagtgcacgctggtcaggatagacttaagattaagtcacacataagcaagttttcaccttcgcacttcaggaaagatctaatgcccgagcacgtgatgcacggcattgatcgagtaaagaaaacaggcggtaaagtacgcgagtatctaagtttcattggttttacatctactggagataataatgaaattgacgacataatgcgacacattcataaaatgggcttgtatcgagatctatctgacgcggatgagtactcatcagtatttgatgttgcaaaatcatgctccacgcaacctataatcgatctcatctctcgaacctctccaacatttcacgctctcctatctactgttgactcagaagttagaggcgtggtattaactcattatattggattactatgtgacgaattgaatgtagcgtgcgtgcaacacagatcgagtgggaacgaacgcaatttcatacgtataccgatagtatcaattgacatgactatctaataagtatgtagctaaaatggaacatc

SEQ ID NO: 403 - DNA, 2203 bp, Unknown
  derived from dsRNAs of unknown virus
ggggttaatgacccgtggtttttacacacacaaatcattaactttactgtctcttagcctgatttcactcagatggcacccccgacatggggggagagcaacccgttttacgggatagagtgactttatgaaatggataagaaatcgacacacttaaacaaagaggtatttacttcgttagttcggtcggattctgttaccaaatctaaagttcgatctatatggcgtgagtttgacagacaatttctactctgcacacgtgcagaaggaaaagtgaatgctctaaatcggtacaaagagtgttattcgtttcttcgtaataatattctcgatttagaatactcgctaccagcattcattaaggttgattcgaatgggattccaaagccactatggcccttgcgggcacttataaatggtgataggaattcacaacgaatagctttaaccattgcacgtacatgggaatcaatcaacttagatccagttccgaacttacttccaatcacgtccgaacgccgaatttcttggcgaacgaagatgtgtgacgaaagttttcagggttggatagaagctgaaattccaatgtacaaatggttaaggcctaaaccttacactaagcgtttcacagtttgggattccaacggctctggacctaacggtccagcagtcgcgtggtcacttgctgatttaatacctttgaagtcttctccaaagctatgggattcaatacaatctttaaatactatctataatagacaagtattaaatattatgatgaatacccttattccagatgaaaatctgaataagttaaaacagtgggtccactctaaaattgggttcatctctgagcccggtgggaaaaccagattgttcagtatttttgactattggagtcagagtgctttaataccactgcaccaccaattaatggaaattttacgatccattgattgtgattccacccatgaccaaaatcaaggtttttctaaattgattaaacggtctaatgggagtccatgtttctgctttgatttatctagtgcaactgatagaattcctgcatttcagcaagaactcataatttcagttctctttggtaaacctatagcaaaagcgtggatctcagtcatgactgatagaaacttcttaatgcccaataaaaccttagtacgatggaaagttggtcaacctcttggagcgttgacttcatttccagcattcgcactatggcatcacatggtcgttcaatatgcacattatacttatttagttggcaaaatgcccagctctttcgaaccgggggatagttacatctttccttggtttaacaagtatatgctattgggcgacgacattgtgatatgggatgaaaatgttgcactcttttaccaaatgatgatggacgatttaggtttagagataaatctaaagaaaaccgtcatcggccgctccaaatctcaactagagtttctgaaaagaatttctctaggaggtttagagatgtcgtcaatcaagtatacattaatgtcaaaggactccgaagctttcgccgtggaccttatagacattttgtttactcgtgacttcattgagccagtaatcgagtccgataagtggatagacttattgccgaaaggtaataggtttaacctattcaaagttattatttggtttcgataccttacatccccttctcttcatttagacagaaaaggtaagatgcctttggtattggaacgaacgacttttgagaataaactcttagaagtccgccaaacaattttaacagagaaaaccatggaggtacaaaggatactagatgaaaatattagtctagaaaccttataccgtaaatggggagccccttatcggaaaggcacgctgggcgaggcaagcttaactgctacactttcacctatagtttgggtaataaaccagacaggagagatcctgaatgatacattatctgaactacacgatccagagtcagtcaagtcagttgaatacattcctatagtatcgaataaaagatattttaagaaacgttctgataataatgtatacttatcaaaagtgtacttaagaactttcaaagaatatagtaacgatttcgactgtcctagtgaggataaacgataattaaatacatttacctctgttgatactctcctgggaaaccaggaagggtatcaacccc

SEQ ID NO: 404 - DNA, 3621 bp, Unknown
  derived from dsRNAs of unknown virus
gtaaaatataaaatttaaaataaaagaactttgattcttctgaatcgctccgttgaaggtcgtgatatgaaatcaattttacatgatacgggttactaacttaatcaaatcttagtctaatggataaagacataaaagataacaaaactgataagacttggccatcttatagtcagtatctcggatactgcagtgaactaaacattacttcgatgctatccctggatgagtggatcgaactcggtaataattgtgaactcgaagataagcatcatcacggacttggatttgctccacctgtgccgcttatgccttcaagacctagtcctcaacttcctaggactagcccgcttttaaacccctctggtggttttgattttggtgctggtgttactgggatgttgggacctaataacattatctctaagctttttgatatatatgacaacctttctgatcctactaagagcaattctgaaaaggtaaggattgcagttgaaactgttcttaatgaagttgctaaaaatgcaggttctaagggcggtaatattaaggtgcctaaagatgcgattagggaagctagtttaaagagttcaccaacaagctttagtgttaaaatgccagctgttgaaagctcatactctcctgaaattccaaacacgttatactctgatttttatcgtacagcaggtgatagagatgcaaatctttacgttactagtctaaactggaacatgcctgctaatgaacctcaggtcactgattatgttgaacgaattttaattcctgatttacagacacgagcaaacatttctgttaatttcaacgttaatgctgaacaagtatttacctttggtaaagttagtagttacatgcgtgaagttatgcttgctatgcaaacatactattcttatgccaatattatcgcttattgtggtaaaaacggtaatagtaacacaggcatgtacgccttaagagacatgattagtgccgaagacattaatcgacttactctattaggtgaacgacttaataatattcctattccacctagattgcgtgaactttcttattggatgagtaatatttacaagtcacaaagtgaatgtcctaacagtcccattatgttaatagttccattttctttcgcaggggcacaacctcctggttatgatgataatggcaatggatattattcaggcattattcctacaattgatactataattgatagattaaaccccgggattgataatcctttaggtgttgatttcttcaacaatagattcatcaatatgttagctaaagtatgtcctggatggctaggtactccgatgggctcagcagacggcgtccctcttcatgatcctcattggatggacgtttggtcgaactctccttgtaaattggttagcgctgatacagctgcattagtaaagtcttattacgttccttttcttgaaaatggtactgataggggtgcagaacttaaatacatcactcattctgagacaatttctggtatcaatcaggctttattctcaacatggcagtataacacagctgcaggaactggttggagtggaatgcttgtaccaaaaacttcaatctctaagaaagcgataggtggagcagtgatttactacggtgtaacaaaccgttttctttttggttctacaactactccaaatggaacttatgaattactttacgcttattctggttcaaattctcaaaatgagggtgtgtttaattacgctaattcacaatctggatggtataatacaccttctgaagatgtaattacaggaactactagtataggagacaacgccacattcatgccagttgattgtcaaccagctaatggtatgaatctaagttcgaatgctaatccgagttaccaatcaactagatggttaatgtctttcgatgaagctctttctggacctggttctgtaaaaggaagaccacctcgaaagagatctaggggcaagaaagacaaactaacaactgaagaatagttggaggtagtgtagaatggatgatgctaatcaagttgatggtgtagtcaaagaagtttcacagttgcttggcaaccagtttgactctgacgctaaacaaaagcttaccacgcttctattcagatcgattcaaggtagtaacgatgttattctctcaccaatggctgaaaaatttggtcctgttactctacttgatgaatgggattctatatttaacggtcttgatgagtctagaattgaaaatactctacaaaatattgagcaagttcaaaaagagaaattctctcccaggtcagtagctataccttggttccctgaacgacagaaggacttagagggttattacagtagtaactctgtagattactcagtcttagattgcagtccttcgaatttaaaccttagtttaagacctttgagtttagctaacacaaaagattttataaagaaaagcactagtgcaggtctaccttcaatgcagaagaaaggtatcgtacttgatcagacagttcgagactttgatgagttatactctcaagctaaacggcttgatctacctagtgttatctttacgcgtacacaagaaagcttgaaaactcgtattgtcttcggtatccctctcgttgtggttctcaatgaaatgcgtttttatcaacctcttcttaaggtgcaaaagaatcttccttggcgttcagcgttaagaggtccagatgacgtagcgtctcatcttactgatataattgatgaagctaaaagaacaggaaatctcctagtttccattgatttctccaaatacgatcagtcgattaatcccgaattacaagccaaagtaggtgagtattataaggctgtctttcagagttctttctctgacgatatagatgaattaattcacattaaagcaaatattaagatagttagtccgactggtataacaagtggtggacatggagaaccatccggctctgcttttactaacgaagacgattccattgcccaatactgtattgctcgccaaagcaaaattccagttgaaggttattttgacattcaaggtgatgatggtgtttatatggtcaatcccgactcatatgatactttcgtatctaatttcaataaatttggtctcgatgttaatttagaaaaatctactactagtatggttttcctaacttatctgcagaatctgtaccatcctttctaccgtacggcagagggtacaatacctgggatctatcctacttatcgcgctctaaataggatatgttatcttgaacgttatatcaactttatggaatccggactgttaggtcgcgactactttgctattcggactctaagtatcttagagaattgtaagaatcatccatatttcgaggagttggttagttttgtacttagtaaggataagtacaatctatcacccagtgctaaaggtattgctgattatgtgaaatttgtcagtgaaacagagggatttagcagtgatattattaatcagtacggggatgatgtcaaaggtattagaacctggaaggcatttcaacttgttaataaattacgagcgtaaactctggggatcatttatgatccctcc

SEQ ID NO: 405 - DNA, 1821 bp, Unknown
  derived from dsRNAs of unknown virus
gtttaaaacaattgaaatcttaatttcaaccataaaactttacttaagttttatattttgtaaaatgcctttacgcattttatgtgtagccatccttaactttctggcatccatactgtacatggtaaaatggcacaactacttagctaattactaagtataattctataatttaattcattaaaggaataaacattatgtcttgggctttccctaaaggtaccggtcaaatggtcgattctggtcaacgtcttatgcgtgatctgaacgcaggtaatgcaactgctggttcaattatcgacgaagctgtaaatcttggcgcaggattagctcctccccaatatgctatcccaattaaaactgcttatgagttagcacagcaagtaaaatctcagcaacaaccacaatctaaaatgaaaggtggtgctcagaaaacgaagcaaagcggtaaacagaaaacttcgaataatggaagtggtggatcaggagttcgatctcctagatacaacaactctatcccggaacaacaaccttctaatgctcgtggaaattcagcatacggtaacgttagtcctggcggaaaagtagatttaaatactcagaacgacaattcgacttataaaataccatccaaaacacaatccatttcgaatgacgaaaactcatctctaacttggattcaatgtatcggaattaaaccaggtgatgtaatgcaatacgtagccaacgctcaagttgaagtggcgtttgatgctatctataagaaatacaaagcttcggtggttgcgaatacaagaggtggtactggtagtacagctctaaactttactaaaacaaacttcattgcttacctaactacggttatgtcaggctatgcaatgttaagtgagtattatgctctcagaactcttaatcccagagataatgatcttaatactgttcttagtagtatgtcagactcagtcaacagtgcagacacactgatgaaatctgcatacagattagatactataatttctgaactttcactgccaccagcagtatgtgagttctaccagtttctgttccaaacatacaaaaagtctcctgtgtctggaggtgttcatcagaaattcatgtcacatcaattttgccatgattttatcggtgatgatgcaactttcgcctcaacggtatcagctatggacgctgtttatgacacgttaatagcaacagagtcgatgacagttatttcagctcttatgagccaaatctcagattataattttatgatgttagataaggtcaaaagtggctccccaaatattgaatttgatatgaaagcaaatgcaatgtttgataactcgtctattttatattacgacggtactgatcacattgtgattaatgacgaaatccagaacggagacagtatgaaagctgcattcccaatggaaaagactgaagttccaattcttgtaacttcgtaccttctacttaactttgagcaagatcatccaggttatccattctttaaagtgaacaaagaaggcaaccatgctgccaactctttcattttaacaaataaaacgactcatacgacaggcgtcgaattccacgctgtcaaggaagccagtaagcaaattattgaccacaattggcagattaatactagcagcaacggtgcgatgttcttaccgaagggtctgaacactcaacaatacgcacttacgtatacttctacatcagatgcatgtcaagaaatggttcttgacttctttggtgttgctcgttagtgacacatggagtcatctcttcttttaaagaagaggtgtctccccc

SEQ ID NO: 406 - DNA, 1999 bp, Unknown
  derived from dsRNAs of unknown virus
agaaaaagaaaattaatctataaattttatatatgaatacatatcgtttgatataggacctacatttattaacattgaagaataatcgtgggaaaaaataaaactaattcgcacttccgtcacctacataagaggtccggtttaacaagggctcggtcgaatgagctaaaaagcgaacagacttttatggtcgagggtttaccagtcggaactgaagaagttaaagagcttaccacagttaaaggttctagactaaccatagttccctccaacgattatttcggagcaaatccgtctctattaccttactatatttacgataaagagtctttagaaagactacgtatgcacgtaagtagggttttaaggggttcttctgttgattataaatctccttttgtattcctcatcaataaagtaataggtactagtgaggatgatatgaacaaaagagaacctataatagaattctttcgagaatttgttcagaggagtccaaccattgttaatagtcgctcattgttacaaagagagttttctgaacttaaaaagattggtactacttctatctctctaccctggaatttcgtgactgaagacgggcgaggtaagaaggttaatgctattcaatactattctgtaaagaagacagctatagatctcaattcactccaaatagctattaatcggattaaggataaggtttccactagtgtgcctttgcagagaatcactcttaaggaagctttagaaagatctgataaaactactaattgggggctccccttctggctaaaaggcaacgaagaacatgatggcaaacgtgttgcagatcatcattatgatattgctgccttactagagtcaaagaagctacctttctttaaagcactttgtgtactggtagaaagagttcagcctaacgggactgatgaaccaaaacaaagagcggcgatggcttttcctcattacgtaacgctgatagaaagtacgtttcaaattcctcttcttaaccacctccggaaatttgagggattcgaggagtatcgtggaagagaagaagcaaacaaaaaaataaccttattacttcgaagagctaatgaggcattgcttattttgggatttgacggtgaatctttcgataccaacataattagagagctattagatggtgcttacgacatcgttgcttctctatttcctgaagatgttcgttggttggtcgaagaactaaagcttcaaaacattgaagctgattggttaacacctgacggcatttatacgggtcgtgttgaaggcatgtcatctggttgttgtttaactaatattatcgatactttagtccagtacattcttatagagtattgtgctgaaagacatggtttaagtgacgaagaaaaggatcagattatgaaaattatgaatggcgatgatggaaattggcaaattcctagtcttagtaaaacagatatggtttcttattgtggagaactcggtatgccaattaacttctcaaaggcccttgaagaaactgaatttactgagttttgtcaacgttattacgaagattctccaaattatatcgatcataatggagtatgtaaagacaaccgatctatttgtagaacggttaactctattctctcattcgagagaaaacctagtccagactttaagagtggattttatagtttaagagttattggacaaacagaagaatgtgctaataatcctatgtttgaagagtttattgagttattaatcctaagtgatgaagacaatggattaggaacaaaattttctggtggaacctccaatttcatcagatcactttcaagaagtggtttcggagcatttgaaaatttagcgattatggagaaggccaacagttacgacaaggaaaaggctgggaatctagacaataagattatttctcttagagtggttgaacttttagacaagactgggaggtagataagaggggacctagccctcctct

SEQ ID NO: 407 - DNA, 1521 bp, Unknown
  derived from dsRNAs of unknown virus
gaatagaaatcccttcccacgatagagagtatggagctacccttagatataagaataagcgcccgtcaaagagatggtttcagatcgtccagtgcgccatggattttgcaaggcatgcctcgtaaaatcctaaagatggcaactgaagacgaagtacctgaagatatcgaagaatacatgaagattggagaccaggaaactcgtcgagatgaactcgcccgaagaatgggtgtatctggcaacgtaatctggagtgaattgaatgatttaatatatgatatgaacgaaagaattcacccaggcacattggatttgtccgaaattcgtaaagtaaaaggaaagattgatcttcaatcagtagtttgcacgattttagccaataagaagataggaatgcaatatttccaagtcttagacaaagtgtaccagccgaagaatacaactgtaacgtatactaaaccatcaagtgtatacctagatcacaactcacgacttcaaatcgtaagtggcacacgattgctggactaccttacaacacctagcgatttaacaaatgtgattgataattttaagttacgtttacatgtaaaagacaaagcaatgatattactgtccagagctacggtcaggaaaggaagaattgacattgccctaaatttgtcgccagatgatgataaattcttagatgcaattgagcacatatcttccaccgaccatatcacatacgggcaagataatataattgcaccctttgtcattgaaagcatgggtattgataatggaacaatcgtgattcacatttttagtgacgtcgatggttctgcattagagcaatggatggcatggtgttcagaaatgttccaacgtatgttatattcggttatcagcactctacgcgatggctcacaagcatattattcacctggattaggcggacaattcccaattcaattcttcagagctttcaaaggaactgttgcggctttgaaccgtgaagtgaactttgatagaatcccagataagctggctattgaagagttgttacatgcgtacgcacgctcgaagaaagatagaattatggatgagaggctggataaagtgtttggtaatacatcaaaccttgaaagcttcctgactcatttcttgatctttgttcaatcgttcataatgtttaataaaattgccacatacaatgagcgagacgatagaggacgttacaaaagtactgaggagagactaaatgtgtcgcgcgctgttgctaaaatagcacgtgacggcacaggcctcatctcaatgaaatccgctaacgatgacttcgcttcaaacactctaaaaatgttgaagacggcaagccctgatagcatgaccgcattttcaacatttattgaaactcacatctccgacatacgcgcttatatgtaactaagatgagttctatactttcatggataacgaaatggcttgacacccctctaaattatacctatagtggggccggccgcggcaaaggatggtaacatc

SEQ ID NO: 408 - DNA, 4228 bp, Unknown
  derived from dsRNAs of unknown virus
gaatattttaaactacataatgcagaacataattgagttacaacatgaaagagaaaagtcaattagggataggttacataccatcaaggacctggtggagcaaacacagggaacggttaggccaaaacaggcacaagcaatggttgatgtcggaaactctcaatttgagatgatggctaatgtaagcaaatactttatcaatgtactaaaggaatatccagaggatggcgctcgtgcgatgtccatgatagaacaatgggctatacaagatagagcgcctgaaaatcaaaatgtaactaaaaacgactttttcccatgcgtaatacgttcaattaaggaggatgagtttaatctattacaaccaccagccgtcttgacacagcatggcatggataggatgctgcgtgcaggagttaatggcacacatggcgtgtcgaaggatgatttctccacctcatttgttcacaacgtgaagaagggtggaatcaccatactagagaaaggatcatcttgtgtgattaatggtgtggagttaaagctaacgccacagagcgcaagatccacagatacgaaaccgccaactgatagcgatgtatcatacactgaatcatggattaacagatggagcgaggccaggcgatacagccctttcaccatgtgttcgagctacgctacatggattgctttgtatcaggaaatggatattgactggccggaagccaagtcacgcggaggttttccactattagttggttgcttatacttagcgtgtgaatgggcgtgtcgaaatggtaccgctcttaagagtggtgctaaatcggacgatggtttcagtgtgaacatattacaatcttggattgatggatcatccattagaattccgcagtggatgaatgtatggcgccagccaataagttatactacaacaacgttaagtgacgttggctacgagaaccttaaacctcgtggattgatggaatggtcacgaggcgagctcagcaaatcaattggtggaatagtcccggcggaaacaagaatgcctttcgtagagcgctcagaaggtggatttccactacaagacgctgcgttgacaacgatggggccactacgcatgtttctatgtttcagcatcgcgcttgagacaacaggttctctacatctggatgatcctaaagaaggatttaatggtttcagaaactatttggaaggcgcgctcctataccttgggaaacatccaggtcaagtcggaagaaagatggataaagtggtcgtacagatgatgcgattgttgagtgctgatgtgtcaatgaacgtaccagaaagcgaactggtaaaacaacaatttgaagacgtgccatacgatagctcaatacaaaggaacgtgcgtatatatgataattactcgctatcaattttggcgcataaccataacgttgcacctaataaacgcgaaatcgcgacaagtatatctcgtgaaataccagagctagagattggtttgatggaaatattcgaagagtacagtggtagtgattcagctgttcagaaatataacgtgtcaatgtatgatacgcgactattagacgcgataacgcacctcacccaccccggtaacatcgagggttacagcagatcgtgtcatggatctctaccggtaaaaggttataagtcgaagacacaacgaatcgtgctggaggggataaattctgacgccccacgcaaagttgacgaccatgaaaagcagctgtttactgaaatctttgatggtttcataccgccagattcaaatggtatgtttgagaacatgtgggcgttgtcaaattccaggtcaggaggtggtgatagaattggattcaaggcctcgccgaaactgatagttgattccgaagctgctagcgactttgaagagggtttcgtttcaaaccgtaaagatgtaatgcactttacggccgctttcatcatgaacgagaaatcgatgatgacgagggctacaccagagatgccgtttccactaggtttacgatcagttgcagcgcgtgtgttgcgatacatttataaccttccgataacgcagcagataattatgagacctatatataaacatataaaagatttcatgtcaaactctgatgagggatacgcgatcgagcaaaagatcggagttgcagtggctgatatggcaaacgaaatcaatacctctttgaaattggtacatgatccgtcgcttgtatgtctagcgcacgatgcaagtgcgttagatcagcacattggatctcgacatagagaaatatggcgtgacgtgatgaaggatgtgttatcatactatgaaggcgagagcctaaaaggaattctaaagagcgacgtcaaatatagtgagcttgtcgacaacgtattgtcatcgtgggacgatgcttactttgaattttcagttccgcaggcgccgtcacaatttttgcatgcggatacgcagccgtcaggagctatcacaaccggttcagataacacaatcacgacaatggcaatgctaaatttgatagaaaaggaaacaggtgacgttccattcgtaaaacaagtttggggtgatgattgttactttggtatgcaaatgcgtggcgatagtgacataataactaaagtgaaggagcatgaggatctagcaactggggctggacaagtactagggactattaaagattcaacaagcggtagagttgttcacttcttacaaaagctattcattggtggtcaagtggtgtcgagacgcatggcgtatgatcatgaaaatccacaaaaccatgaaaggctgccaggacaaataggtgaatacctggataaagcgagagatctatccatgcgtggtgggaacttagtactgttgaacatgctacagctgatgacagtgataaacggctcaagatctactgtattcggcagacaggcggtgacatcatttgagagtatggccgcaccaggtggaacaacgaatagaatgctattcggatttggacaaccaaactcgaagttatatctagagttaaattttgataagatgtttggcggtacggaaaacatgactgttgattctagagcaatcatcgatactcccaaagagattggaaagcgagtaattgacgaactatcagaatcaaaagcttcagtccgtatgcagctaggcgggatggaggtaaaacgccctgacggggagaattacactatggatcagttacagcagacggcttcagagcgacttttaaaacgtgagaggcgcagaaggtcacaactgcgcgaaacgactcgtattgccctaacagatgcggacgtaattgaccatgattatgagcgagctgtaatccgtggtggatacgatgcactaggtggaatgttaagagataaacgtttaaattcaaaattcaaggaaaaggctttaattaagaatgggtttatatctccccgggctgacaagcaattttcacctgaagtaaaacagtcaccagtatcacgacatctaagcatcagagttggaaaagcctttgttacttatggtttcaatagtacgcatatcctatatttaccaaagacaagcgacgaacattttgacttaatgtcagtcgatggaaaccaagtgcacagatacaagcagtactggcacccattttacagttatcccataaacatacgacttttgttggcgttaacgggtgtacacgctggaccagatcgattacgaattaaatctcatatcagtaaattttcaccatcacgctttaggcgagatctgatgccagagcacgtaatgcatggaatagacagagttcgaagcaagggcggaaacgttcgtgaatacttaagttttgtcggtttcacatcaacaggtgataataacgaaattgatgaaataatgcaacatatcgacaaaatgggtctataccgtgacctgtcaaacgcagatgaatattcgtcagtgtttgatgttgttaagtcagcatcgactttcataataatggacctaatctctaaaacttctccagcactgcatactttactctcaactgtagactctgacgtacgtggggtcgtgctaactcattatatcggattactatgtgacgaattgaatgtagcgtgtgtgcagcatagatcgaatgcgagcacacgtaatttcattcgtataccgatagtgacgattaagatgacaatctaatatgtgtgtagtttaaatgtaacatcc

SEQ ID NO: 409 - DNA, 2614 bp, Unknown
  derived from dsRNAs of unknown virus
gaatgaagaatgctagaaagaacaaataatatacaaagataacggagataaaaagtattttgggttggtgaagctccctagtccctcattgggatttcgcaatgagtgagatcgtcacttatggagagataactactgaggaggagatcaacaatcaacttaagcaggaattggaaagcttactacctacattacgtactagaagttttgatgatcgttttcgtgctgcaatccttgagctattcactgtattcgacgatgtgacctttgatgagggggctatttctgagtcaataagaaatgcgtggtccgacttgaatttaagcgactccccattacttgatagattcattgagctatttgacaatggacgcctgtttagggacagcctcggcgacacaattggcagtagagtagctactcattgcattgatctacctactggcactagatacactactgatatcaagcagcgtgagttaagaaagcttttgcaattgcaattgaaagccatggagagcgtcaatgacttacgtcggaacaaacgtttgcgtgatcagggtggagtaaatgaaaaaggtcagtttcaatatctaacacttagaggtgcgcgtatgccgcgttctgtaacgccaggggaagcaaacagaatgacaagctataatggcagtgatgaatacctcatgcatacgaacttcagcaggtatgaacgtagtgagcgacttagaacgttcacagaaccaccaggtgaagtgaattcctactcgtactctgcagaagaggcatatgaaatcacatcaccaaaaaccctaaaagtgagattcgagaaaacagatgaaccacatttttctttaccgattcagcaaaagtcgcatgtcatcacaaggttgacagaatatggttatggcaatactattgaagtacaattcttagatgatataatggacgctgagatatcaggtggacgctcagttccacgtagtgacaaagagccacgcagtccaaaaggtgctagctatacattacagctgagaataccgagaacgcgtgttaaatatatcatgaaatcgacagagccaggtcatggcgatagcactgctccaactttagaatcaacagtgattttaagcgcatacgttactccgagaatgggtaagaaatgcagcttagttaaattcataaatgatggagatggacctttagagctgaaaaacgcttttatcatgactataatgccgttaatgacgctaaatccgcatcatgaattaaaagcgaccagcttccctgtgtccgcgtcgtttaacgatgtgggtgataaccttagtgtactaatgttgacgtcaggttcagattcacgaaatacggacgatttagcgagagctttcaacaaggaattaagggagaccgaacagtggtctaacataaagtacgctgagctactgagtatgtgtaacttagtatccaaacaaggagtcaaaaacctagggaaaacgttgcaggataaaataagatcgtccaaatttataatgataactgagaatggtgtggaattcgaagatgtggaaaacattagaaaacaacatccagtaattttcaaaatactcaaacgatttggtttaaatctcctttggtaccaaagcacaagatcattagctgagtcagccaagcctgattataatgaaatatatccgaagtgggaagaattcttcaataaatcctgtggtccaagtatcactcattccgagaacattcgatcacctaatgaagggcataccggagcaaaaaccatagagcccgaaatacttttagttaggctcgcgttatcacgtatattaaatgttggaattggaattagaaatgagcatgaacctacaaatccgaatgctcgaactgtcccttttcatataacaaatcaaaaacgagctaatcttacgagcataccattatgcgtcctaaaagatgagttgctagtgtacaacctgactggttcgttaggaaaactatttgatggaatcttaccaactgatttctgttataaggatcgaaatggtaacatgagcgaatgcagaaatctaaaaacgatggtatcaaactcgagacatctgaagggaatcaaatcaccacaaatggcactaaatgctgcttacgtgttgttctcagtaacctcaccattaatcagattgggtgttgatgacgacgaaaataaagttaaccccctgcgtgtaatttcgccttctggggatgaatttgacgtcagcttgattgctgaggaaatatgcatgaagcttttgtccatgattgagttaagaggtagggcaacaaaggatgagaccgccatagtatggcatccgctgttctgtatcattgttaatgtaacacagataagtaatgggaagctagtatgcgacgtaattttaatgccgtcaaagcgtccatcctcactatccacatcatatcataatacaaatgatgtgttaagggagatggaatttaaccatgacgtacgtgttcatttcgcaatgctcacggaaaatctaggttacgcaactggactaaacatgcacctccaacacaactatgtataatttctggacccacacattctcgaaacatc

SEQ ID NO: 410 - DNA, 1449 bp, Unknown
  derived from dsRNAs of unknown virus
gaataatattaagcaactttgaaagattataaataagagatacaagatggacgatgaaatggaaggtgattttgaggacttcgttgcagatctggcggagcagattgacgtaaatgctgcggatagagatgctcatgcaaacagagatcatgtgattgaaaactcaaaacttgaggtaaataaagagggatatggacgttacaaccaaggtgtaaaagatattcaagcgtgtgtggctgacccttcaagaaatgcgttgaccggaaacggtaagctagtattttcgctactagggcgctcgaatgatactactactgaagatattgatgaagagtataagctgaaagcaagtcttacaactgctacagagaagttagattcattaaacgtaaggcttaataataaactggtacttatgtcaaacttcggtaaggatatagttgaacgtcgtaacgcgtacagtaatgcgagcaggagcgaagaacctgatagcagggctcaactacgaaaggcgatagaaaacctagcatccgctgaggatcaatttaacatgattggtgatgaaatcgttatcatcgagcgtgacgttgataggcaacaagttattgtggatgggctgggtagcgatttgacgaaattcagaaagcgattgctacttacacagtttacagctagatccgtgctctttagtgacccctccggtatgatgagtaaagacaatatggaaaatatcccagatgaacaaaaggacttatccttaatgcagctcattcgacaagcaacacttaaagacgtcatatctacattgaggacgctagaaggcgcacacgttaagaatgatgatgattcgttcgcaatgttcgctgacaccggcgttggagtggatgatacgattaaatcatggagcgggatgttaaacgacaacatgataacggattaccagtactttttgaacaactcaagcgttagcaagtcaattgaagcgattttcaatacagcgtatgatatggcgagcattagacgagggaacgtgaactacgaattacgtaaaacaacatcaaaaacaacaaataacacattacaacgagaattgtatttcttaaacttaatcgctcaatcaggttacgatcccacacgttgggcacaggcattcggagtaccaattagtggaattggaaaacgcatcctggacgagtggaaagatagtggttatgtgcccattacggctgatgctttgacgcaattatttgtgtatgaggattttaatcagtccattggtattgattactctagattggaagaagcagtcattgaacagttcaaaccgaagaataaagacaaaatagacgcggatgcgcttctaaatatatttaagaacattgaacgtgacaatgaaggtgattctgacccacgaagtaattaaatttcatattgcttaaatgaaacatc

SEQ ID NO: 411 - DNA, 1617 bp, Unknown
  derived from dsRNAs of unknown virus
gaatattatgattactatttagtgttctggaaatgaattcagtacttagagaagttcccatcttcgacaataaagtggatattcgatcaagactcgataagaaaaacgaaactgacccgataccagcacatacaagatacattagtaaccttctgtctgggggagatttaaaccgctctggaattaacgtggtggctaaaccaagattagcctttggtaatatacattacaacgcagtagagcaaggtcaatttacgattgaactagcgggaagagtcgcgccttcaaataacgaagtgcgaatctatcttggttacgacaacggcgaatttcgacgaaacaccgaatcgagtccgaattacggagggcataataaagtgtactacggttcaaatttgttggttcaatcaggatccccagcgctatcaataaaattatacaagaagccagactggaaaatagagacgcaatttggcttggatcctaacagcgaattaattgtaacgcattatcacgcaactgaaggctttccaaagtggccgcctatattgactacgtcaaacaacataccacttcctcacgatctgaacataacggataagacggaattatttataatcggacctccatttgattatagaaagggtaagtcaacttatcaccaaacgaggtcgttcattgcttactcaccaaagacaagtttgtcggaatataaggagatcgtacgtgaattacctaaaggggtaagatcaagcagttggattgaaatagaattcgactcaacgataactggtgcaaattcttctatcgatatattttaataataaagcataatggaaatacaagagcatagtgatgatgactgggaggcaaccgaaggtgttttacaaagactcaagcacagttgttttgcgatgcatatgctatataggcgtagatttttccagtcaaagaaacgtcttgcatattacgatgtaccaataatcggactatcagccatgaacagcgtccttatcgctggagggaaagatttcataccacaacaagtgttacaagtactaacgtgttttcttgcagtgattgtgggtataattcagtcaataaagaactacttcaaaattgacgaaaatagggagaactgcttggtcacgttcaaagatttatttaagctattctgtgaactatcaataatgcttgaccaaccacgtttcgcaagagcggttgatccgaagaaatttactattgacaaaggaaacgagtaccaagcgattatgtctaaggccatactccttgaggatgatagatcaaaaatgaatccaatatatgaagacagccacccatataccccacatgtaagcggaatatctagacttttccgtgggattggtagcgagacgtcctctaagatagacgaggaagtgatgacgttagaaagagggacatcaatgaccataaaaaccgctagtgtggaggatataccaataatacctgacccacgtggagaagatgaaccataactaaagatgaatgaagtttctacgtcattatgtcgaaatgacgtgctaaatgagtaagcccttaaaacaggatgctcctagtgtaattatatgaaacatc

SEQ ID NO: 412 - DNA, 2107 bp, Unknown
  derived from dsRNAs of unknown virus
gaatataatttccatatattaagaagatagataatttaaagttatttcaagtacgaagataagtaatcaagtcaatgaactctacaaaggaatacgctatcgaggttgccactacggcgcttaactccttccacaagcaagctcgtggagatttggaggcgccaaacggtgatgaaaatgtcgggatgtacaccgctcgtgggggatcagccgtcactctaaccgcgaacacgacgagcgctgccgttgtattcgatgcggaagcgtcgcttagaaagggacaacttgacgtcgtcgtgtacgagcgcaacagtgctaaccaagtggtggctcaacagcgcgtcaacctagggcgaccaacaaacgagttcctttctgcaggtgtgctgagttctgcactaaaagtgttcaattcctctggagttgacgtgattggtggcactcaaagcgctgcggtactgacctctgttccacgtgacatctcgaagatcacatcgacggacctggcgaacaactgcgctaaccacgaacgtgacctcgcttccggcatcgtatcaagggaggactcgacgatgactatggctatgaccgaccattttggtaagaaaatggccctatcacggaacaacactctcggaaaccttgtgctgcgaagctgggatgatggagtcggagctcgtggtacgacgacgggtcagagcttgacgtttacgggcacggctggcatgaccatccttcactccagttcgtttacggatgctcaaatcctcgagaacagcgatacgcctaaggatcttaccactgccggtgcattacgtcgattccttgataccgcgcgtcttgacgaacaatacaacccgttgacacttgcctgctatcatgcatcagttaatgttcgttgcgtgtttgctgatactgatgtgaccaacgctggccagggttacagcgctgtcattatggcattggactcagctgataacattatcgccagtaaagaagtgtcagatcgtgttgcagcgaatgatgggagtacgctagacgcgcgattttacggctcaatcacaagctcaacttcacccatcgcgcgtatcgtagttggagcacgtaagactaaccttgccgctacagacaacatgatcgttgaatcgtatgctgaggtaattgcctacgaggaaacgtccgatatcgccgctaggcctattcacgtgtgtgtgtttgagggcctaaacgcttctgccactatcaacattaatagcgcagctgtgcttactggtgtcccagattctacgaacgtgttcatctcttcgaagtcgagttcgaatgatgtttacgatacaaacgcagttgaggtgtttttgaggtctgtcacgagagtcatgcccagggctttcacgatagatggacacgccgcaatggttagcagtgttgacgcaatgttcggaactgaagacgtcagtatcgcattccaggcgatgagctttgaaaaagtggctaagaaagtgaagaaaattggtaaagttgctaaagcaagggcgcaagagatccctgcgttactatccgaactggccccggcgctcgaagaaattggctctaccctctcgatgcttccaggacctgctggtacggcaggacaggccatgcgttccatcggtcgactgtcacgctgaagcatagggcacttccccagcatcattatgatgaatggaatcatgaagcccggtaggctgcactgcgtcatactatcacgataccccttagaaaagacatattcaataagagggtcgattcacgtcgatcataacctaagagatgttagcgatgatatgataaggttgttaacggatcatgatgtaaagtatgtgtctttgctacgcgataatgtcgtcgaagggaactcgtgggaaatgtcggcggcgcaatcactacataacgtgccaggtgtatattcaggtactataattgaatatataccaaacaaatcgataacctatggtgaagtgccaggattacaagaaaaaggcagaatttacaaagaattgatatcaagtaaaaatataaagtcattatcactttcccggtgataatggatgtggaaatttgaaacatc

SEQ ID NO: 413 - DNA, 5261 bp, Unknown
  derived from dsRNAs of unknown virus
gcaaagaaagagaagcaatgatctttctgcgcggcctccagagatgggcttagttgcttgcctctggggggtgttggaggggcatgtcttactgttcgtaggatatgttgggtgggccaacacgtagaagcacttgtgcttctcaagctgacgaccatgttgccaacgcactaagtgctttgcattcatctagaagtttgaacaacatcttagcgctctgcagtcaagtcctaacgtacttggctcagtgactgtagagacgccgtcactacttgcgacctgaactgctgtcaaggcaaggaaccatgcgaccaccctctcgtgtgcaggtcaacacaccaatggcctgaaagggaccggaggtgctagtttgtgacgggagaagatggactacagctaaccattgtagaatggggctgtgcagtgcggggagagtgcccacattgaagcaaacaactagttgtctacttagggctctgtgctacggcctgtccactacttgctccacgcaatgttagaacgacaacaacacactatcatgtcaaatgcaaccaatgaacaagaaggggacccaacttcaaccactcaaaacctcgatcaagctctcgctgcgcaccatgcgctaaatgagctagatgacatctcagccgcctcatcagcagctgaggagtcatcgaaccaacaaacatccagtatggggggatttacctcattcgatatagcacatcgcttctttccagtcagtgagacgtcacgacggatagtctcacggtttcttcacgatccaactgcttcttactacaagttattaagaaacatgtactctacagctgagccaattaacgactggctgactccaacacatttggacgacttcgacgcagagaactacgacttggacgaggagagtgaacacatggcctccctgcatgctgagaaggcgttagtcgaacctgcctttgttcactatgctaacattccagggcaaaaacttgctcttgacccagctgtgatcactgatcaagtcggtgccgagtcagtgctagcctcaaagctctttgaccctagatcgcgacagatcatccaggaggtcagagccacatctgaggcggtctcggtgctcaatagcgcactgagccatgggatcgggacttcaatggctggtcctttgtgcaccatgatgacagccttcgcaactgagttcagatcgctcagccaggtactaggcatggggtgtgagacacctgaacggatcgtgttccacaaagacagctttcagagcacttggcgaagtcagtcgtccttcgcggtctggacgtctaccggctggttcatgacgacacaaagccactacatcgagctgactgacggactgctccacaagccagaccaagctgcactgtggttgttcgctttgacgttgagacgagtgccgtttaagacggtgcatgtgtacaactgcccgatcaaggcaaagacgatcacaatcagtggaactggacagattgaggttgttgatcacgaaccgccgatcaactcgcaatctggtgcagatgagtctgatctggaggaggacttaggagtagaggaggagactgagactgaagaggctgacgaactaagtacagaagatgttgactgggctgtcacgctggtcaaacgtctcggctctttgtacggacatgaggactacccgattgacatccccgtcatgatgcgagcgcttgggcaggtgctacgctggtctcagcacttactagctggatccggaagcacaacagcagcctacaagctgatggccgcaaccagctacacgcagttctcagagtgtgagagcgacgaggggaagacgtgccccaacttgcatctcaactgctggaatgcgacacctggttcaaccatcaccgagtgcagtgcagtcaacccgctagtgctgtgggcctacatgaacaggatggttgctcttgatcctcaagaggagccactaccgctcaacacaactccacatggtgttggcatggtagctacagtgttcaacatagccatgcgagcgcatagcgagatcgcgatctcacaaggtggactagacgcgtacttcacattggctaacctgccatcatcaccagacagtgagatgcgctttcatcaccaacaactagtgcaaagcagcattgactcacactcctctgtcacgatcaattgtggcatccggactaaggtcggcaaccctgactcgttagtctgtcaactgtactcagccttcataggctactatgctaggaacaagccctgcttgtcagccaacaccctaccactctggcttgtcaacgtgctatcaggcgaagcacagatgatgccttctcgaggtgaagtgactgtttcccgagtagttgctcctcctcctcggtctggtgatggtctagatgacatggtcaccgagacaaccgaccatgatgtcttctggacatggggaccgagctttccacgatcaccagacctctacacttacatagacggcaagtacggtaagccatctatgctttgtgctaatgcttacatccaaccagacgtctacaacatggacacttacagtcagactgctaccatgatgttggttcctaagcactacttgtactcacatatggtgcgcacctttgctatgacaccacacgattgcacagcagagtgtgttgcacccctcactcacatgcggatcccacaaggatcggtacctgtgcgtgaccgcccccctatgatgctgggggatgcggcttcccttctcaactctgcttttcgccgagttgtggatggaaaccactagagtacaaacttctgtgccgagagttggcatcactgacagcggactagaagtcctgcgacgctacatcaactacccttggttaccaggggcagttgtggccgcgcaggagttcgctgactttaagacatcaatctcttcggctgaacccgctccctgggatgagagctggttcaaaggactacagaagaagtacagaccaccagaggacaagtccaacctctgcccgctagcaacgggcatcccaaggcagcagatgggactggccctctctctgctaccaacaaccatccgcaaccaagtgactagcacttggatgcacctacacttacacacactcacaaacgggcaactgttcattgccttcaaaacactcggtgacattgctaagcaccatggcaatctactcttcccagggtactggaccttcatgatcgactggaacttgcactttggggctcagccaacagaggacactgatgatgagttcactgatctgatcgagtcatgggtcagcacgcctaagccagaagacgcgatcggatcagatcgtgatgtgatgatcatgcgtggcttggatcgacttgagtctgatcttggtagaccagacacacctggtcaaaacattgatgacttcttggcctctccgtcatcttggctaagcaacggggcgtctgactcgcggaagctagaaggcactcgtgctactaagttctcaacctatgcagcttcaacaaacgcgcagctacacacagacatgttcgacccatcatgcccacactatcgtgtctttgacaagagagagaagggcaagcatcgcaacttgatcagctcaccttggtctctcttcctacagatgtcattcgtagggcagcaggcagagagccgcttcaagaaggtagttccgacatccttgtcgaatgactggactcctgagagctggttgcacatcatggacatgatgcgcactaagttgtttgttccgatcgatcaaagcaagttcgaccacgttccaagcaagagggtgcttcttagatgtgcagagattctctgcaaatctgggacatgcccactagacccagaacgtgagatgatctcaaagttgatcttagacagactagctaatgcgacgctatcctacaacaacaacacctactcacaccagagaggcttgttgtctggatggcgctggacgtcactaatgggcaccatgatcaactacgctgagtacctaagcatcacggactccttggctgtaccacgccaactcaaagcaaatgtgtgctttcaaggcgacgacgcactgattgcagttaatgactgggcagacgctgtcaagatagttcagcgctacatggaagtgctaccggtcaatccaagcaagttcttcatcgacaacaggcgctctgagtacctgcggtacgtcatcacacgcaacagacgtttagggtactaccctcgtgctgcttctggcatcatgtacgctaactcatgggcaggcggagctatggaccctgcgtctcttgcttctaactggagcctcctctactcgagaggtgctgacgcgaaggagacgctctatggatgtgctcgtgacctctgcggactattgcgatgcaacgttgacgaagcactggacctcatccagacaccgtcgtctgttggtggactgggctggtacgtgcctggcttccaacccaagacatggcgtagagtgccgttcgtcaagcgcactgagatcggcaaggatcgcttagtcattgagaccgactacgacaacatacccaaacacacacgcactactatggttgcagccgcaatgcaacggggacattcacgccctatggcatcggttgtagctcgcagtctatcgactggactggttggcatcgcttctccagagcgacccaagcagcggttgatgagctacgggagaccaaaggtcttcatagcttcgcgtgcacacacacaccacacaccaaggccgccacaaagcctgctagacccgttgtacgtcaacgcggcggtggcatctctcgatcgcaagggtggactgcgatggactgatgtcttccgttccgatgatgttcactggttaaaggcgcgaaaacgcaactggggaatgaagctgttcaacaaatggagcactggacagctctccggttacgccgggaagcgatggggtgatgccccagacttcttggctgtagtgcgtagacgcgttgaagcagaaggcatcttgccatctggacacatgtcgatgcaccgagtgacgactcggctgctcgagttagagctagcttctaggttctggctcgtcgacacacgtctacggctaggtgcataacgtccgaagacgctaaactactgcgcatggagagttttccgtgctaaaaaacataaagtttttgctttatgtccccaacagggacataaaattttt

SEQ ID NO: 414 - DNA, 886 bp, Unknown
  derived from dsRNAs of unknown virus
gaatattcttacgtaagctacaggccatgttttcatttcatcgacagagtgttaacatgcctgaaagacagcgattggtgttgccctccgatcgattgtctattgaagaaaagtttgaagtagttgactcgttaacaatacgaattaacaagaacgagtcgatggtggcgcaaataaatattggaaaagacgaaaatggagagacgtcagtatacatgatgaacgtaaacgtgccgtgggataatccaaacccagatgtacacgtaacttacaatcgtgtagcaaatgatgcaatcaacccaaattctccaacaatatcaaattctgagcatgataactcattatcggcggcattggcgtcctatgaaaaggatttggtacatgagataacatcaaaagatacacaacaaaccataaataagggcgtattcgatgatgctcttaaagcgctacctaatatcaaaacgtctgcagagagttcagatgttgatgaagcttcgctatactcatatgagaagctagatgatctgccaaaatttatgtcaatatcaccaattggtaaaaagtatcatctaagactaaagaaggatggtggaatactttgtgacttaaagagtgtaacacaaaagcccacaaagcgtaatgtctacgtcataagtgaaaaagatacaacgcgtagagatggtattaatagctcaaaacttacactcatactgtcgaaaaccaagccaaaacgtcatattgacgtgcgcgatctaccaattggggtggatttatggttaaacataaaggacggtattgagtatgaggtaatgaaacaaattcgtgaattactagtcaacttcttcaacttctaatcgaatacagcgtacgtacgatgaacatc

SEQ ID NO: 415 - DNA, 7527 bp, Unknown
  derived from dsRNAs of unknown virus
cataaaataaaatcaactttagcaactatggggaggaaaagttgattttatcgtactgatcaggtgaataaccagaactatcaacataatcgatgttgtcgctgcagcacagcggaaccaaattaaatgtctagtgaaggccgttttactcatggcgtaacacttcaaaaatcaccatcattatacggaagtaccggcaatgataggttacaaaattttgaggcccagcctcgtggtttttgccgaccaggtttcacttttaattaaaaggccgaaggagcaagaaaaatacaatgagttccataatgtgtaagtcattcccctgcacgggagccaaggaggtaaagccttggactgacagttcaacagtaattgaacacgagcctttggctcaaccccataacaacgacaaacttagtagatattgcatcacagatccgaatggtccagtggtggacattttatgttgcaatattgaatgcaccttatccgggcggaagaatgttttacacattcaaccacaggtaggatctattgtgtcacttcgatgcatgttcaagctatttgaacatttcaggatcggagctgacacacacttatatgatgatgacaggtttgctgacgcggaagacgatccaacagctgatatcgctcaattacttggcgagttaaccataaatcaatcagacgctgattcgcaaattcccattgctgacggtattaaaccagaccagaatatgatctcagaatttaaattcgatgataattacattaatggattgtgttatttgcatctgctgccgttacagttgcggccgcaagccagctctcagttaggaatgtaccctacagtttcagagtttgccaaatttacttttgacaacctgaagaataagaaatataaattgtactgcgaaatcgacaccacattgcattacaatggtaaggcagggtatcatgttgataagcgagctaatacgtccgatgaaggattgttagcaacacttgagtcacttgagcaggactgggttattggtggtagtgaaaccgtttcagaattaagttcggtgatactcgctagaactagcatgtacgcagcaacaaaacctataccaaaaaccatcatgaccgtatcagtaaacttcgctaaacctggagaaggttactgctaccttaagttctttagaaaggatcatagagagaatgcagcaaagtcattaatgtcttggccgaaatctcatatggtttatgcaaaactcatagagcttggtgtgtcagtgacaaccggtgtgaagttcaagctagctccagttggttttaactcctatcatttggaggatgcagaagatcaagttaccattgaagaactgtttaacacaataccgggaaatgctgccattggtggattccatgaatacggggaggctagaattaatggaatgccgccaaaggggcccttcttatggtcgttacttgcatgctgtttcagtgtgatatatcaacaatcatctttacatagaaggctagaggaattaattagcaatgtgaattttttaaaattcatgacgttatttgacaattattgggtgaaatgtttcacaataacattgctgattttacaactgataatgtgcataatcgcagcgacctggctcacgccaagatgctattatgtcactgcaaatggagcgagagctgaagaattaacagtcagacccagaaccgtgccagttatatctgtaaatagagcaagaacagcgcgatatgtggcaaataataggatagcctttgcgttcgcccttgctaatccacagtacactataactagtgttgcagatatgctgaagactttgcccaatccgaagaaaccacctggtcgctccaaatgtgagacacgtgagtctgacgacgattcagtgactaaggctgctgtggacaatccactgcttagttctcaacgactgaatgtgagtgtgccagacatcacatacgaaacccctgtggttatcagaccacataaaaaggagtcagacacagtcataatgatgccagcgcttttcaatgacgaaatgcaagaatgtatgaggcaagaaatgaagccttacatactgcaattcacagaaaatcgcgaggtggcgcccttctctaagacatcaatgaattatcttagaactgtgatgattcaagcatgcgctgcaggtaaaactgcatgcgtgattgatgacgatccagtgaactatccactagatgggttctatcattatatatgtaataatcgacccagagattggcacgcacaccttacgtctattgatcatttagcacagacaagagccaatggttataaaatttggataaagagcgcgcccttgtaccaattgaataatagatttgattatatgctgatgccattaactcaatatggttacgacataagttacattgtgtttaaatgtctgagatgcagcattgatatcatttatgccattgaatacaactcattagatttgtataaggaagcaagagggccgctaccaggcgtaggattgaaatggcgagcattagggaatggcgacaaacatacaactttcgagtttagtccaatagacgatggtaattcaaaatcttacttaaacagagacaatgttttacgacatatgttaaccaaccaagtgcaaatagattcgtttttctattgcagatcagtaatgctgcaatgtggcgacatgcagttggtgaagtatactaggcgaaacatcccattaaacgacgcaactgtaaaattatcaaacttttactgccgacatttcagtagatgtgtttcaccattcagaggttctacaccattcacgaatgctaaagcaaaagtgatgatagctcccactagcacagtatatgtcatattagctaaattaagagatcaattggtattcaactgctctagcgttgccacaacattatacactttaagatctgtgtatgaaaggaatataatagttgcatgcgccaaaggatggatcgaaagagctgttgactgtaatccactcactcaaactttgatgcatgccgcgcatttttacaaagagctgggtcctgagaacgacggtagcgatatgttgacacatgtggatactacagtttggcgttacttaaagctaatattcagtagaggatacaggcgaaaaacttttgcggccagggcagccaaaaagttttgccatgtattcacaaatgaagaaatgattcctgcgatacaaatctcaatcacatccgacgagttacaagagttatgtgatagaaatgtctacccacacattcactcagataatgaatatttcgattattttccaagcacctttgcgttcgctgatcctgacgaatatcgtcgtatgttcacagacttattcatgccactacgggcattcggcggattgtttggaaactttatcgcatgcttgcaagtattgctcataggcgatgaaattgatacagccagggtagccggcgaatataatgcaccgctattaggtgataacctggatttagaagaagcagcagctatagctgcagagatgcatgaaagcttagaaagagaattcgctatagaaggaaggttcaacacaaatgaattacatgcagctgaggcgctggaaacaatgtctagattgcgtacgagcagaacatcaaacactacatcactagatggaggtgtgacacaaccaacctctggctccatagagccagatcaactaaaaattaaagaaaggttgctcggtcatccaacattccatcacacaatgaatgcgatacatgaactagaagaatataactcggtaacaacccagataggtgagacttacaagacaacaaataatgctctcgttgaatgtgtttttcgctgcccagatttagcacatcaatttgtaataaataattgtggtctaattgatccctgggaatatcatgataaactattatctgaaagccaaactatattgattaaaggaaatctattcataggagcggcagagacgaaagaaatggttacaagatcggtgatcgtagaacacacggatgcaggcttcgttcgtgtcaaacccacagatgcagaagcatttttcagaagattaaaagagtacatctgcatcgatggcaacacaaaagatttattttcattgcacgatgcacaattggaagatgtgcctgccggaggttgctttttcagagctatagggcaagtgataccgcaaaataaccctgtagctcaaatgagtgatgttataagagagtgcaccaccagcaatgtggcaatactatataaaggtaacatctataaatcaacaactgcaggcaataatccgacaaaaatgatctatgttcaacagaaccattgcatgaaattaagttccagccgggtaaaatatctgcttagagaatatcctaccaaaagcttgaatgagttcactctaagcttgaacggtccaattattcatgacacaattgaagagaggctgagagatttaaagaaatacgagacaaaaattaacgagctaaaaagtggagatccaaggctaaaagcgatacaagaagtgctgctatacaacatcactctagaacgcacactgatcagaaagtttaatctcatttcagatactaatgccttgtcatatctcagagccacaacagaaatgtcggtatatgacacaagatgtaacaagtggataaatggaaacctaacggagcaccatgaatattgctggtcaaatggcaagttccaacaattaaaatacaataaaaaggagaacatattctcatgcgagtcccaaggcactttcatatttacaaataaagacatcgtgtttttgagagagagaatgttactcgacagagtgatgccgctatggcacagcctgattacttacccctttaaagacttgataataactctagttaacggagtagcaggctgcggtaaaactacaaccatagacatagagcacactgtgaaccttgatatggtggctacaggaaccagagcatgcaaagaagattatatgaagcctggccgtaataaaaattattacagaacatatgactccatcatattaaatggagcaccacagtgtgatacaatgtatgcagatgaaggacttatgattcatgcaggcgaactacttatagctgcatacatgtgccacgcaacaaaaataaaaatatttggagatgagcaacaaattcccttcatcaatagagctttaaattttgcaatgcataataacttagtaatcccagatgaaatccgtagacaaaacatcacatacagaaatcctaagtgcatgcttgcaattttaaagcagttctatgaagatgtggaaattggctctaacgttgaaggagaattgcgaaagattaaaatcaatagcgcaacacaagtgttagacgactacgatgcctatttagtatttacacaggctgaaaagaaaatgttaaatcatttacctaaagagaagatatttagcgtgcacgaagctgaaggaaaaagcttcaaagatgtcgctctcgtcagacttatgccacaaccaaatgcgattttctcaagtgaaccgcacgtgcttgttggcataactcgccaccgcaataaattacattattgcagtgttctagagaatgatttcacatggcagactttgagtatagagaaggagactcctgaggaaacacaggaaagactcataaaatgctttgatccaatacaagcactgcctgttacacctccaaagaggatgcatgcaacaattaatagaatatgcaaaatcgacccagaatacaacgactgggtggaatggctattcagtcaaacagaacacatcacaatggaagacattacctaccaatgggaactattctcaacggaatggccagaaacgataacaccttgtaaatgcccagaattatccgacattcaagcactatattatctcatgtatgctccgaatcccaaattggaacaagagcgattaaaactaggcatgaaattccctttaccaaatcaagtaaaggtaaatccactgagattattaaaatcaatgtttaaaaaagcaacagaatatttgataccgaaactcggaaccaaccagccaataagagatccaggggatatatgggccgcaatgaatgcattattaaaacggaatttagatcccccagtagtgcactttgcaagaccacctgaaataataaaattgattgtggatgtattctttgacacttacattgatgcaaatagattgaacactacaaagatgtttgttcctttcggcacaaaagcacacacatattcatggttcaactcaagaataggatcaaggaagaaatccctaataagctatggaaaaagaatgccatctgaaatacattatgcaacccacactagacctgatatgaaaccgacattgacgggagcgcatgaatttgaagcagcaagcggccaaacagtgacagcacatcatccaaccataaccgctaaatatgcaggaatgggacaatatgtttcagatttattaaaggcatcattaaaagatcaatggttcataaatgatggaatgaaccaacaacaattaaatggagccactaacttcattctcgaaggcgttaaagagttcattcctcaagaagttgattttgggaaatttgacaaatcccaagaagaaatatgtttagctgtgcaattagaggtcatgagaagattaggagtatctgagcacacattagaagaatgggaaaaagcacatcaaattacagtgctaacatatcacacacttggtataagcttaaaaacaaaataccaacgaagaagtggcgatgttatgacctttataggcaacacaatcgtgctaatggctacgttagcatttacacatgattacaaagcagcctatggaggaatattcggaggagatgacagttgggtggctttacatccagataatgcgttgacagattcatcgagcaatattgctcaaattttcaacttaactgcaaaattagaaaattttaaagatgcgcagtatttcgctggaagatttttaatacatgcggaatcaaactactactgggtgccagaccctgtaaaaattgttactaggttaggaaggcacgattactactgtaaagagcacttagagtacgcctggatatcattttcagacaattatagaatgtatcaaaacttagaaatcaggctaaaagcctgtttagctgcagctgcaagataccagagaatctcaaaacaagaaatttatgacttgagtttatttggagattttattgctgcgcttaccctaaacaaaaagaactttttaaatttatttaagagttcttggaggatatggaatagaaaactacccaaagcgcttaaagaacaaattgggcgacaacagtcacgccaaagaggacttgtggatatcacagaaagcacagacccctttgaagaagactttttaatatttatgtaaaaaaaaaaaaaaa

SEQ ID NO: 416 - DNA, 848 bp, Unknown
  derived from dsRNAs of unknown virus
gaatattgaacagtaagagtaaacgaaccgagagaaatatcacaaatcttttcattataagcaataatcatgtctcccgatcccgtagtatcatcagatgctccactttcagagttccattggtcaaaagacgactacgaaagggacgctgcgagtgccatagaggggatcaaacgtgctcgattagttatatccagccatatgaggggagttgctatcgagcacagcgaggaggtagatgagattgtaggcataattggaaacattgttagtgacgtacatcaaatgattatgtgctgctcaatgtatcatgctgattccagcattgaacattgtgctttagctatcttatgcgatgaaatgcacataactgtttgggaaatgcaagccgacatattgagaagcagaatgcacatgttagattcaagaaggagatataacagacgcgcagaggtgcgcggaatcacattagatgcggttgaaacatcattctcatattctatgtatttatcaacatatgagcgaatgctttcttctacctgcttagccataagaggcgcatcagagtggcaccatcatatggctttaatgcacgaccaaatcactatggcagcgtcgagagatgcttcagacattccgagtctaatggcggatgatgatgacgatgagccagaaactggtgatacgacggcatcatctagcattggaaccgcagcggaaacgcttgaggaaatagtggaagtattatctaaaccacgtagtccaattgacgtctaaaataagaaattgatacgatatcgaatcgggggtgttccccaacttgttattcttactgagcatgcaacatc

SEQ ID NO: 417 - DNA, 590 bp, Unknown
  derived from dsRNAs of unknown virus
gaaatatatgaaactagtactgagtgaacgcgataattccggaatcgtgcccggcgtttgccgtgtggtagacgatcatgtcacctgtcaccaattatttaatacgacagccggtcaggcctggaagtacggcaagttgtcaaattggactaatgacaagttgtctaaaggggaaatcaaatgtgattttacaggaagcactgatattggtgactattgctacttccatagtgatctcaataagaacgacactgcacagaggtatgcgtggcataatgtagctgtcgctagtcgggataatgtcacagagctggcttatagtaggaacgccgaatacgtaaaccatgcaagcagccacatcacactaagcgcgttgttgacaatgtctgcaacggtggctgtgatagttgtagtcaccgccaactcactatgaggttggtgtgactcatgtggtgatcaaccgccacgtcatggcttacggcaccgagtttaaccgaatgtcatattgcggacgcgtgacgttaaaaagtctcagcaacaggtctggtgaaatacagaggctcgcgttcaaccaggctggcatcatgtag

SEQ ID NO: 418 - DNA, 1114 bp, Unknown
  derived from dsRNAs of unknown virus
gggtttctttctccatggcaaggagtcaaaaccataataggaaaactctcacgcggactccgcgtgggtcacccaactatgtgtcaaccaaggcaactacaattgctttgggagacgcagaagatgggccctctggtcggacttgcggtccgagcacgggggctcagaatattaagattcctgattttcaggtgaaccctgaattcaaggaatctggtatacgggggcatgcgtttgctgcaacagacgctgactccgctaaacatactcaagagtcatttgacatggaatttgtcaaaacaattgagtggaataacgattctgccatagctgtcgctaatgcattatcgaaaaagaagacgcttgatgtggtaatctcacgattccctgaagcgtattatcatagtaaacttatgctggagcgtttaacgttccaggaaacagtttacaaagtaaagagctgtttctcaccactagacatggtgagaatgtcttttatttatggtcctcaatttgcgtctctgtggaagactgcatgggaggccaaaagacttcggtggctaggtgttgaaacctgggttacaccggaagtaagttacttcgaaaagggcatggatttttccaatggccctaacggagtttataatcatcggcatttcatcttttggaaagaagaatgcgatgactacaaatggtctctcgaccctcccgcggaagtggacgaggagaccttagaagatctcgaagaacaagctttcgtttgttcgaagaaatatttaaaagatgaagatttcggagacgaaatcgacattcttttggaaactcttcctgtttctagttcctgtttcctggaatcggaagggaagagacgcaaagagtgggaatccgagttttacaacttgtaccactccaaagaagaagctaatctctgtggttatcagagtatggctcctaaaagacccggggagactagggatatcaccatcccttctcctggggtactcagacgctgtaaaaggctgaatcgccctttaaagctctctattaaaagacttcacacttgccctatgggtaagtccaaagaggaagtcttaaaatccataatggaaaacca

SEQ ID NO: 419 - DNA, 655 bp, Unknown
  derived from dsRNAs of unknown virus
cgccccgtccggcgactgcgccagcagctcccagtcgatgctcgccggcgaccagccgaacgactgcaccagcagcggcgccgactccaccaggcccgaggccgaggtcaggtcggcgtcgaagcccgcgtcgagcaggcggcgtacggcggcctcgtcggtgccggtgacccccagccgctcgcgcaccgccgcccagtcggtccaggtccagcgctggctgtcggcgggggccagcgagaccgcccgctcgaggtcgctgccgggcccgcgccaccaccgcacccccaccgcgagcaccgcgatcagcagcagcgtcaggaccaccacgccggccacgacgagcgcgcgccgctgcgggctcgggccggccgtcgagacgtcgtcgggggcggtcgcagaggggctgctggatgagctgatgctcggctcgggcacgggtcgggctcctcatcgcggcgacggtggtgtgagactacgggcatggcagacgtcccgagccggtcccgtgacgtcctcgccgccggggtggtggtcttccggcccggccgcgaggtgctcctggtgcaccggcagcgctacgacgactggtccttccccaagggcaagctcgacccgggggagcacgcgagcaccgccgcggtgcgcgaggtcg

SEQ ID NO: 420 - DNA, 4840 bp, Unknown
  derived from dsRNAs of unknown virus
gaagcatttaccaacacaacgacatggaagaaaatccgatatcctcagtcacagaactagaaaccggtgggagcgttgcacttcattgcgcacgtatcacacagggtctggatcgattgcttttgaagaagcggggggcgagagatagaggtcagattactccaatccttgtcatcgcacacaaagcgaatgatcaacatcgtgggtcggcagcttcaagatggctgtattctgcagcctccagtttagtcagacgcacgcgtttgcaagtcgcgaatcgttgcttcacatgtttggtggatacgtacacgaaaccgtgggaatccgttctcatggagatcgaacgtgacattcagactgagcgtggtccgacaggcaaggcggaagtgttcatcttcttcaacattgaaggggaggagcgcgacgaggctggcttcttaccatggcaacgttacatgaatgacttcactgcgtcattgaacttgcggcttggggttgaagttgccgacgtacctgacgaagccgtctcggctaagcttaagaaggtacgagggctcttcacctacctgcagggtacgatttcaggtggaatcaacgatcgccacgtccgtgagggtgctgatatactgaaaggtacaattcaggaacgcgcgatcggaagcaatcaaagcaagatgtggcgtgcgctttgtggtcaaatcgctcatctcgccgaccatccacgtgccgatggtatcatcgaagatatcgcggacatgtggcgtgcagacgcagagccagtcgaactatctgaacgggttgaaacaccgacgtttgtgcgtgtgggctgtccgacagttccacctgccgtcgtgactcgattgggactggattgcttcatcatgcgtgaccccaagtttgctgagcagaacactggctacgtgactcctgacatgatggagttcctcgaatctgagcaagatgaggacggcactgtcaagtggtttttcaaggagacggacgactatgagcgcgaagagataatcttcaacctttcgaaagatgaggagccgaacgagaaggcccatctatcgcacggttcgccatggcaattccagataccgagggagactacgaggcactatccgaacacgattgtcacggagatctcgcagttgtggttccacatgcaacagatggctgcagcgcgcaagttgacagctgacgccgaagcagacttctacttcgacgttggcatgcgatacatgctaatgatctgcggactctgtgcttgcgagtggatggcctctaactccaaggcgctgttgcccaagagtcagaaccccagtttgcgtgcctatcttaaaggatgggccggggggacgaaactcaagattgcccagtggatgtacatgttgaaggagaaaggtaggacgatcaactatcgttccgccactgacttcggttataatatcaaaccgactgatgactacttcaccatgcatgaacatgaagcaatggcgcagaccagggacacgaagaccgtcgatgcagcagccgctttcgtagcgcaggctgaagatcaagcgccctttgctgagcgtatagcaaaaggactgccgccactgctttcgccatcgtgtctgacgacgactttgccaacgcgctgttcgatccttctgaactgtcttgttcaacattccaatttgcatcactatgatcgccgagtcttcaacgacgtcggaatacggccatgggaaatgatcatgagaggaatcgccaactacctgattcatttcaaaccaggtaagaagctgaacaagatgttctttcagtcagcaaaattcttgttggctgcgcccatgaagatcgaagtgcctttgtccattccgaacttgcgtgctcctgttgaacgtgtcaaaatttgcgagagttttgacccgtatatgcagaagatgatgcagtcaacgcttgaaaagccaggtgcgtcctttgatgtcttgcttgaagcatgtgtggagaaagttcgtgacgccggcgatcttatcgccgatggaatgagaactgtactcaacttctactctcgcttaccagttactttctgggacagcgacaggttgaaggtgttacatttcatgttccggccagatcaccccggtggatatgcgttcaccaatcaaggtggtctgtctgcttacggacatgcttcacacgtacagaagctgcactccaaaccgccacttgactgctctttacagcctgcgagtcacgaattccagtcgtcagttctcgaccgaatcatggcgaagtacatgacgttaccatcatcgaaagacgacgtcttacgtggcgcccgtcaactgcaaaagggtacgtctggtggagctgacaagatgttggcgaagtcgaatcgcgcggaggttcttggcactaccaaggcgaccgacgccgacgttaccattcctctgaacaccaatcggaagaatgtcgtactcgccgcgttcagtcacctctacatgcgtaaggggccagcaggtaaggtgagtgacctgattctcagatctttcgaccgcgctgtcaagaacacgactggtgagcgttcagttccgagtcgcgtccttcggatcatctattgcgtcgacaacatgtcccaattctcacagctcacctttgtacgcgccgcgaaggaattcttcaaggaacacaaagtgtactcaagtgagcataagaagtctgggcaattcgttgaagactacaaggatgagatccaggcctcgctcgaggtcatggaggatggcagctgctgcatggcctatgatgcggctgctctcgaccagcatatcgccactggtgaccgacgtgttttcatcgaggcagtccaacgcgcaattcgcggtggtgccaagtcggcagcgtcggcttttgaaaaggagtttggcatctcggaagcaacgttcatgatcgcttgggcaaccaaacgcttggagaattattttgccgtgagggtgaatggcggccctgctcaagcattcctggttgatacgcaagcgtctggcgaattactcactgcgataatcaattcaattgtttctcaagcaattgttgatttcgcagagatggttcggatgggactcaaccgtaatccagccgttccgggaggtggcattccaggcggcgtgtggggcgacgacatctggcgcaagtaccttgcgggtgaaatcacacctgagaatgtacttgatatgctggaagctttcgagcaggctgggagagattgcggacaggactattccttcgagaaggcactgagcggcatggtcgttcatttccttcaaaatggaattaaagctggtcagcaattttcccgttgcgtcgcgctcgatcacgaacgtcgcgttgagcctggtctcagcggtttgaagtcgcttcttgctaagatcaacaagatctgcgctcgtggcggaaactacgttacgtgccagctgctgattaactcagcgatatgcgctgcgtcgaagatcaccgtgttcgggatgcaattcacgtatccaacccctaccatcttctaccccggaggtgcgctcaatcaaatacctatacctttcgcatctgagaattcgaaagcgtatttgtcgatgaatgcgcatattttcggcttcaaaggaacgatggtaccaccgccctcacccgaggatgctggaaaagttggcgagcgtgtggttgacaagctttcaagcgagggagccggtgttaaagccgtcatcgtcggcgagacggtgcgagtcccgaacttgaaggagtcgctcaaacaaacgtgggcagctaccagcgaaccggagcgaatggcgaatgattcgggcatggacatggtgcatgatcgtttgggggccgcctcgtacagagagtggaacacgaacgtcttcaaccgcgccgtcggtacgcgttgcattcagggcccagcacaacgctggttcatggagcaagagttgatcaagcttggcatggctcccgagtcacgtgcttctggcgtaacttacgccaagatgaaacgtatcaaaccaagaacgcattaccgaatcggcgacaagaatctgcgctacgggtggtctggtttacgtttgcgtgtccgacgtacgaagagtgggccagacttggtatcttctttggtattcgaactcgttaccgaagaagacaccattctcaagacttacaaaggtcggtggcacacgttttacagtcatctaccctcggaaagtttgtttctcgcttttactggtgtcggcgtcgggaagtacggtagccagaagatcgctatcgggtcatcacgagatgtgctgcaacccttcagcccctctcagtttaggcccgacctaaccgccgaagccgtggttcgcatcctgatggaggtgaaggacgtgtcgcgcatgaagttgctcgccggaatgggttttacgcatgaggagcagactgctatcatggaaaacttcaacggtgtgggcgagctgcgtgacatcgaggaaatggatgagtactcttctacacccaccccactcaaatcggctttgcgcgatcgttttcttgacatcctgagtttaccagaggttttcaaaaccgatggtgacaattcaggattcaacatcacgctgccgagagggtttggggtgcagttacaagaaggcatactccatttcttcgccgagttactctacacggaaagcaacataacgtgcaacatggagaccgatatccttgaatctctgacaagaggaaaggttgtcgatctctgctcaataccgagtttcgttctggagaatatcgtttgatgaatattccaaatgccgtaaggtgggtgaaaactatc

SEQ ID NO: 421 - DNA, 3928 bp, Unknown
  derived from dsRNAs of unknown virus
gaagaaattgtgaaacctgtgaaacgttacaacaacgcaatcgagtagtgaaagtggtcatcatggcacttagcgcaacaacgaaaggcatcaatggagttgaggtcaccgcagttgacgggagtgaactgacccacgaaaagctggagttgctgactatgtcagtcacttccagccgaaagtgggacatgttcgttcaaatcggcaacaacgatgattttgacctgtgtctgtctgaagtgctaaaaatcacgcctggactacaaaacaacactattacggtaagctgcatggacgatttcaacagtttgattcccgaattccacgccagacgcgctcttcatccgcagatgcaagtgtgtctcattgttttcgacaatgaggtactttctgacattgcgcgctcatcagcactggtcattgacggcgacactgtcatcagtgaagctggtttgtggccaaaaacaccaggctggtggcgcatgcatacgtcagagaagtaccttccatggacatccgaaggtcacatgaacttcatgttcgccaaggcactcaagcggtgcatggaggatcatccacaagcgatggttctgttcaatggcgggcaagatttcgtgaagcgtcattcggatctagtcgcagtcgttatcgagacatcagagcggattctgcgacggaacctttcttcacgtgttcggaagcaacgcgatcaaggagctggagatgtctacgcttctggacaagaggcgtcgccagcgactttctggcccaactcgtacgtcgcgctcagtcttccaattacgaaagacaaagagttaaccgacgatgcacggcggccagtgttctggaccaaagatcgcagtgtgcccggtcatccaacgacgcaagacgtcgaatgggacgagcatgcaatcccaggcgtcgacaaactcaagttcaacgacttgatggaacaacagctccattctcaaacggttgaagctgccaacgacaacctcgagatcgagcttctctcgttcgtgactgcttcgaaggctcctgtggacatttggttccaaggcaggtactttggacagaacccggtccagctgagcctcgcgatgtcggagcgactggagcaagctggcgttcagagtgtcgtactgagcagatctgatgttcacgccgcgagcgagcctgccatcaaggcttccggtgttaaaccagaattcggaatgacttttggctcaggacgtgactgcgtcggcgataacccatacattcttggtgggtaccgaactgaaaatggcgtgccttcgacacctggcgagcgtcatgcagtgatcctgtggaagcttcaacttctccgctcatttggactgagcctatccttctacgtcggcggatctactccgaaagacggagtgctcaggaagggtcagtcaatgcattcggtcgtgtgcacacatggaacagacgctcttgggtttgcccgttatgcggggaacaacaaggattacgtcgtcctggtcacgtctgaggcgaactatgaatatttcgtggatcacctcaacggtctcaagtctgaagctgaaagggagatgatggagaacgccagaaacggaaaaccaaccggtacacccaccgttgagttggtgtgtccatcttgggaagtaagcgctcgttctctctgtcccactcgtgtcgacgatgttgaatcggacgcaccaccaccatgcaagacgtggttcgtgtcgttgagcggtgacttgatgaacctgtacgataatgatcgtgcaccacacattgagttacgtcggaaagcatcgtgcaaggcctggaaagtcaagaaagggcagcgttttgcgctggtcaacccacgattgatccagcctccgcggacgagaaagcgtgctgtggtctgggacgtactcggccttcttcgcgaagagccagacaacagtggctacatgctcgctcacgttacggtccacttcggttcagagcctctcgagagtttcatccccaagaacgttcttcatttcaacgcgtttacagggcttgtccaacgtgtcgaggaaccagccggaaaggcgtacccacaaccaacaagcatcgctggttctcttacgaatcagcgtgacatggttgaggctgcggctcaggaagggattgacatcgttcgaggtacgttcgaagatgttccaaaggacacgaagggaatcgtcatggcaacattcggggcaggaaagagcacgtttgtcgaggactcgggaaaacagccaatgtacgctaacgctcttgatctgttcaaggctgctgctgagcgtgacaacgcgagtacatttggaaaactcgctccccgatcgagtgacaggacagggacgtggactccgtcggagtacgcgcccatgctcaatcgtcacatgtcacgtgcgtggatggacagaattgactggatgcgccttctcagcctctcagcgaaccttgactacccgggcgatcgcacttcgacgttgaatacgctctggcagctgtcacgtcgtgatgtcgttgggttcatttgcgtcgatccagagctcgagcggttcaagtcagtgatgaaagaaatcgatccgtctgccgcagcacttgggaagtatacgaacaagttgttcgcctttgatgccagacgtgtgatcgagcacaacagcattggcgacgctgacgtacctaccgtgacacaatcgttctgtgagttctactggacactccgacttggaattggtccatgggataacgaacgcgagtcatggaagggtcagccagttcagagcgtacaccacgcgtcaacatacgctaacatgcatctgttttcgacctcgccctatggtggtctcttcggcccagatggtggccagcaagacgtcgttcccctgtatcccgagctcatggtttcgggtatttgggatgcgactgagctcatcggcaccaaggcgtctgtgaagtcaattgacgctgcgctcggattcgcattcaaacctggcgtcgcgtcctcgggcaacgttcgtgattacgaatgggtcattcgtgatgcgcctgttcgacccgtgactgaaggtctggtgcaaatcgtcggctcaagcaagccaactgcaatgagtttcaatgttgaggtcattggtcttgacatgccagtcgagacacccatcgtcacatttgccgagccggttacgctaatggatggcgcgacgctatccatctcagcaatcgagcgacgtgagggacgtcattttgccatcgtctatcatggagatgatgaaatgacgcgcggtgaagtcgagctccgcaacgagactcagtcggatcaggcagtgaatctgccagccacgttgctcaagaacgggattactgcaatcctgctgaatcgcgatgccatcagacctgatgacattgtttttcggcctggcgatcgtgtcgacgctggacatacagtctacctgacagccatcgacagagcaatcctgcacattgggcgacagacaaagcgatttacctatgaagatgttgtttcaaaagttcggatgcgcgtacaaggcacggacagatcaggtcatgcgattcttgctctacggttaccaccgttgcaacttcgtgtttacctcgtctccgtcatgcttaaccatttgcgcgcctatgatgccaggaacttctacgagtggtcaggacagactctcggaaggttccacactctagccgactacgatgctgctgttgatttcgtgcgttcacgtccaatgacgaagagacaatcctcgtcgcttgacctgctcgcggatttcattcaacgaatgcacaagactcccttggagagctcgcctgggtctttttacctacgcgaactctcacacaaaagtctgtgtacgctgatgaatcctccacgcgacaagtgatttcacatttaactatc

SEQ ID NO: 422 - DNA, 3432 bp, Unknown
  derived from dsRNAs of unknown virus
gaagaagaaaccaccatggaagagatagctggagaagcacaacgacaagttgagtcacacccgattacagcagttcccgatgctgctcggcgattctttagtgatggacgactcactgattcggagatcactgcgatctacggagaagtttcctcgaccatcgttggaaacgccgaagccatggcacaactgaacgtcctaatgcgcggaatgctgaatcctttcagtgactgcgcacagggcgttggcgtgccacagcaaccagttggttcccaactgattcacaacatggtgactgagtcatatacaatccctgagggttgtgatcgcatggtcatcgtgatgaatccggttgtcggggcacgcaatggggaggtaagcgctacgatgtatttcgtcaattcgcgactcaccagccgtactgaaccacaacagctgaacgatggctccgtcctgggcatcagaaaactagccactgggctacgaatcgatgacttcaagaatgcttcattgtacagtgccggcatcaaggcctgtgacctgactgctgacgacttcaagcgtggtgcgatttacgcagccgtgctcgacgatcgtagcactcaccctgctcagctctaccctggcaagattggtcgcgtcaccgaggattacctcgttgatgttccgaaagatcaagcagtttcggtcgttatccgaaactccgaattgttcacggaacccaaccggcgcggacttgactccagtcagttgaggtatgccaacctacttcaaggccggtcgacgttcgcctctgcgcctacgcgtggcgaaatcaccgccggtgaggaggctgtgctggcttacaacgggaaagatttgcagtttggtcagctcgctgccaatgctcaaatggcgcagtcgaacaaaggtcaggagaatgtacagacttgctacatcggaaccgttccggcgattccagtacgaccgcactatcctccgcagccttctgagcgcattcaagtgcttagctcagaggatattcctgcgcttcagcagagttgtggcatcgataacattccaatgttgtcgcgagatctctctgctgtacgcttcgcgggaacgctcaagctatgtggtccagtcaacacacttccccacgccggtggaccgagttcattgatggagcagcctcagggcgttgcgatcaagccgttcgcttccgatgcaccggaattcaacactacgggtgctggcttcggtcaaccgttcatcgattcgatcgattcgatcgactctctcggttccgacgtctcagcgtatgcgaacgatggccagcccaccacgggtgcgaacaaccattggctttccggaatcggcacgccgcccggaaattggcgagtggtgctcgagatccttggtatgcgtaaggccgcagtggcagctgctggtacggcgcctgatcccgaagtgcgaccaatcggccgcgctgagatgctttgcatgctcggaacgaaggcgactgtatcctactcagcccaggcggtagccacaccactttgggacgatgttgagttcagcgcgtcaatgaatagcttccctatcgtgaacactgaatccctcggttctgtgtgtatcgacggcatcaccgtagttcccggtcagggtcttgaccctgccaccgaggacccggtgtcgcccggggaggtgatcaccggttggcgcatttggatgcagtcttggtcaggtgatcttgatggcggtcaagcgcgcgatctgccgtgcattgcatcgcagaatacgtgcattggtaccgtcaccgtctcacacgttggcgccggctacatgtcgatcccgaatgttacattcgctgagtctccgctcggtccgcaggcgacagccaagggacacgctatcatgacggcggaccctacggacggtgccactacagtcgctcgcattcttgtgactgatcccggttttggttacacagaggctccaacgattactatcggtgcgccagctgcaggaccgggcatctcaaccgcgattgctacgtgcgctctgaaggctgtccaaggcggcgaacggttcaactcgaaccaattcggtgtcgagttcacacctggttgcttcgagctgatcaagaacggcgctgatgccataagctcgggaaagaagggagtaatcattcttgacggtttgacgccgcttggcgctgctggctcatcttctgccagcaacgtcagtgtcacgctgtcatcgtacgtttccttcattccgaagtcagccgccatgccacagcgcgtgaggccaacgaaccagcaactgctcacctccacctcagctgcaagcgctctcgcgctcgtcgctgattacgcacccagccttcatgccaatgaaatcgctcgacagttgaatgaagccgtcttcctctcccatcagggcgatgaggcggctcttaaggctgcaagcgacggtctgggcgctggcgttttcggtatcttcggtaaaatgaagaaattcgcaaagaaggcgtataagacggtgaagggtgcagttgacagtgtcgaccacggcactaaggccgcacttgcgcgtctggccaagccagtagcgatgcgcgctctcaagaacgtcaaagatcgagttggtctcggtcacgtggctgatggcacaatcatcaggcacgctgaactggcaggcaagaagcttgctgagctctttggcgctcatgggggcatgcatgccggaagcatgtacgctggcaccgatgctccgttgcatgcctcgcatggcgacttctggcgcacgttgacaaaggttggaggtgctgcactaccgcttctgctccgtgacgatagtatcagtacgaacgtcaagctgcagaagcaactgttcgcctcatcccaagcgaagtttcccgtacttagtaagacgggggacctcgctggtacgctcgaactgaccgtggccccgaatccaaagccccttctcacctacaccacgatccctcacaacggccgtaccctccattacgactctcgactcaagagtgttgacgatggccatacgactacgcatgaggtgttggggcattggtttgaggatcatccagaggcatcggatgtttacgtgtcagtgaggaagctgaaggctggccaacacgtatacgggcggtcatgggaagcgtcgcttgcatcagcagtcgctggcaaacctcagctcatcactggtaccattgagcacgtctcaggtaggagcaaagcgccaacagcgcacatcggcggcatcgtcggtgctggcgcaaaggcgcaactctccaatctggccgtgccagtagaaaatgctgctgaagttccgggtaacacgaagcttgtctccgctgtccggctgtaaaccttttccatggcagactgattgtcaccagtcacggtgctcttataaactatc

SEQ ID NO: 423 - DNA, 1143 bp, Unknown
  derived from dsRNAs of unknown virus
gaagaaaacaacatacaagatgcccagcaaagcaggagcgaagatgagcccattgagcgagagcgtcgaactgccgccaagtgtacccgagcgtcaagcatcgggtgccaaggaggatgaggtcgatgttgaacctggccctaggccagctcgtgaaggcagtgctgaagctgaagaccatgacattgacggtggagcggacgactcgttgccaaccggagcggtcgcgttttcctcggacgactacggtaaagtcctggaatacgcactgcaaggtgagaacgagatgttcattctgccgtattctcatggtctggctcgcgcgctgtttcgatgggacagtgccgctggaggatcggatcagttccccgaactcacacgagagtcgggtctgcaatcgttgcgttacatgacgcaatggctgccgattttcacgcgtttcgttgtgatgtccacggtctgcattagaccatggactgaacttcgcaaggtgtggaaggaacacagaccagaactgcccgacgcacctttcgtcggagaagcaggactggacgatctttcgcctgaggctgtgcgcgtgtgcaaggaagaactcggctttgagccgactcagttctaccaatactgcagcatgttcacagctctcacggccgtttcgcatccggtttacccgactccaaaggacgcgtgtgaattcccgtttgaggagcagatctcgtatgctgagcgcagtccgaaggacaaagccagcacaccagttctgaacccagtgggagtggtctacaacagaatgcctttcgacaaacttgtcgagaatgccaaagcattcggttacggacaggacgacgaggaggatagagcttctccatcgcgtcctaacacgccgactgatgaagtcgatgagccgcctgccccagctgaggtcgcttccgtgaagccgagcccaaacaaatgcagcgccctcggcgctcataagtagggtctcatcagccacgggaaaacacggtttggcctaaccgtgtagaccgaagttggcggtgtgcctaaccaccatacctagccggacgtcttgtatcatgttctctgcttagacgagtgagtgactggcacgcgtggacggctacaacatgtggttacactatc

SEQ ID NO: 424 - DNA, 2112 bp, Unknown; identical to SEQ ID NO: 299
  derived from dsRNAs of unknown virus

SEQ ID NO: 425 - DNA, 1629 bp, Unknown
  derived from dsRNAs of unknown virus
gaatattatgattactatttagtgttctggaaatgaatcctatcttaagagagattcccatcttccacaataaggtagatattatatcaaaactcaagaagtggaacccgaccgatccattaccagcgcataggagatatttaactgatctcctaagtggaaaagatacatacgaagcagtcagatcaggatctggggtagtggataaggctaggttagcctttggtgtaataaattatattcctggagagcaaagtcacttcactgtagaactggcaggaagaatcgctcctacaaacggtgagttaggtatcgagcttggatacgacgaaaggcttggcatttcccaagaaaactctgtggaacatccaaactacggagcaagtaatacattatacgaaggctcaaacttaatattgcgaccatacgagccagcagcatctgtgtttttggtaaggaataacttcaactcggcttctgatagcgagctagttgtagtacaccgtaaggaaggtccgcattcaattagagacgctagccgcctgccaagactaccccccgttttaacgtcgtcggaaaatataccaatttccttcgactttgacacacaagataagacgaaactattgataattggaccaccctttgactatagaggaggtaaatcaccatatcagcaaagacgaccattcatcgcatattcaccccaaacaactaaatcggaatatacccaaattgtacgtgatctacctgagggacgatcaacgaactggctcgagttagaatttgattcatcaatacgcggagaggatacagtagttgaagtcttttgaacataaagtgtaatggacgcgcaagagcatagtgacgatgactgggaagccactgaaggtgtcctacaacgacttaaacatagctgctttgcgatgcatatgttatataggcgtagattcttcgagtccaaaaagcgcctcgcatactatgatgtaccaataattggactttcagctatgaacagcgttcttatcgctggagggaaggattttatacctagacaagtgctacaggtgttgacatgctttcttgcggtaattgtagggataattcaatccataaagaactactttaaaattgacgaaaacagagaaaactgtctggttacgttcaaggatctttttaaattgttctgtgaattatcgataatgcttgatcaaccacggttcgcgagagcagttgacccaaagaagtacaccattgataagggaaatgaatatcaagcgatcatgtctaaagctatactgttggaggataatagatcaaaaatgaacccgatatatgaagataatcacccgtatactcctcatgtaagtggcatatcacagctatttcgtggtattaggagtgagacatcgtctaaaatagatgaggaagcggcaacaattgaaagacaaacgtcaatgctcccggaaatcaaaagtatggaagagatcccaataatacctgacccacgtggtgacgatgagatataactaaagttggatacatttcctacgacattatgtcgaaatgccgtgctaaatgggtaagcccttaaaacaggatgccccttgcgaaatcatatgaaacatc

SEQ ID NO: 426 - DNA, 1483 bp, Unknown; identical to SEQ ID NO: 373
  derived from dsRNAs of unknown virus

SEQ ID NO: 427 - DNA, 2491 bp, Unknown; identical to SEQ ID NO: 301
  derived from dsRNAs of unknown virus

SEQ ID NO: 428 - DNA, 3432 bp, Unknown
  derived from dsRNAs of unknown virus
gaatattattggtagaatcttaggacagatgtcggacaaaacagaagcttataaaggtaaactcccacgcccttccaaaactcaaacagttaaggaatttgaagatgaggaaataaagccggatgcagagtacaccgaattcaattcggttgctgaaatcctggcaaaacctcaatacttcaaactcattatcgatcaaccggagttccaggcgatgctgaagcgagagggaatcgaatcccccgatgcctctgagcccaaagccgctgaacaaaagaaggatgacgataaagaaaagtcgaaagaagttaagaaggcagaggaacctgacgagccaaaaccgaacactgaagaagatgagccaaagacatcaatcgatgttgtaatggtgccatcacttgaagagatcagtcctcctactgaggaggccgtgtctgagatagcggcaacaaccaaggtgttcatcccaaaatacaagcgtgtcatgcacaacttaacgtcacccgtatcaatagacgttacccatggattgggaactcttaaaacgagcggacttgaagatatttacactaaatatagtggtgaccgaaaatcgaagaaaggatcaaaaatgttcaaatggcttcagacataccggcctatgggcgtaattgctccaattaagtatgatgcagtcaccggaatggtctcatctgacaatcacagctatatgtttgatgctgacgtcgccggaaacagtgccactgctcataaatacgaaattaacagactacgtcccaaaatcgcagactcatttccgatgtttactcgaaacatgcgaatggatccaagtgtaccagatgcattgactaccggtgttgaagagcgcacgcttgttgacttatcgaccgaacttcgtattgatggtgagcgactcaagtcagcggatatcattgcaaacccatggaggtttccaatgatgctccgtgataaggaggcgtatagatacatgtctttaacattcgatgattggaggcgtgtacatggcagatacattgacgatgtaatgctgcaatatgttagagagaggaatgctaaagaacgcgatgaacgtactaacactaccttatctcttacgctatatgatagatttgttatttcgaacgcgggagcgaacagccaggattattactataacgtgataccaaattctgaaaatgtaatgctctgtgaaacagttcttaaccgatcatttaacaaagcaatggaagcgatctcaaccatcgcaccatcccagcgttcaattagtactaacattacgaatcgacaagcctctcacatgctactgaacttaacctcagtgcagccaagtgatggcgcaaattttgctaagcacctaggtgcgttcctccttggtggtaaaaggcgtgctctggaagttgatatcgacgatggagccaccaaaacgcctttacttaacgcacttagtagcttcgcctctctaattatgttagacgaacgcttcgttgatgagcgcacttataggcagttgatggtgaacgtgcttctacctttctttgatgaatttcaaactcaacgtcaaggcgatggtggtgttagggtgtcgaagggtgtacaccaaattgctgatgatctcatgagacttgaaagagtcgagctccctgaagtcactaaagttgtggatctcgctggtcgtggacgtgcgcgagcacgcgaaattaaagcgatccttactaacctcctaactagattgagggagacgagatacgtgcgtcttaatgagagagctcaactgttcaagacggaaggagcatcaccattcatcccattcaattcacgcgatgacattgttgacattgtgctgtttggaacgagaggtgatggtgaagaatcacgaatgcatgaagtcagttcgtatcgccctgaagccatcaggatctcttctctacttgaggaattcgctgatgtactcggtcgaatgcgtcaatatgatggcgttggacttgctctcacagaagcaatgaagactaagacgcaccttccaatgtcaatggctattttcaacgacgcttttgtgcatggttcaacaaacactgagttgcagccagcagttgaccgccgtgacattagagctagaggtacgattgactcagttatgttgcccttcgacggtgcactttctttccttctgtatggaattggatcatccgaggttgcggaaaccaacaacgctttcgtcagattcaaagcgatgacaacacctctgatgccttctctatacccagtatatctctattttgagagggctatcgcgcaaagcgcatatcgtgaatttagtgatacacttctcattactcatcgtgatatggtggttgaaggttgcattgatgcgcttgctgtatactttgagagcgttgaccccgaatctaaggagcgcattgaatatctattcgatgaacgtcgtaccttagaccaagaggcaggatttgaacttccagctgcgttgacgtcaacgacctttgctatacacgaatatacgcccattgttggaaaggaaggagctctcactttacccggatcatttgacaaaaacaatgaaattctgcaaaagaatgagaggctaaatgcgtacgatgcgtctttagaagcggttgacaaaaccgtaacacgcatgtttattgacttcaaggctattgaaccgatgagaatcgagacatacaattcgggcacatcactcgtttacgctaagcgacctaatgcagatcaatacattaatctacgtgaaattataatttcagcgaaatacatcgacagtgacaaattgagtatcgaagcaattaaaaacttggcatatgttcatatgcgccgcagacctcaggagttcgataacgtagaggtgttaggtgtgtacattgacgatattaagacatcattcaagttcgttgaacatactggactcagcgatattgttgcagccgccccaagcattacaatcgaccgcagctcccgcaacttggatactgattttgaagttagtgaaatctcagtctattatcatcgcatcactgatcgccaaggagcgctttccgatcccgcattaatgcgtgagcttgaatacttatctggattcatgacgcacgttagtattgatgcggatgacatccagaaatgcctagttaactttaatcattccgatccaatgaacccctccatctataaactcgaccttgatggtacgaggatagatgaggacagcctagctgatgttaaaattagggatgggcgtggaattacctatgctggacgtctgacactgtcaacccgagactctgaaacactcacgatcactgatacactcagcccgcgtgaggtacttgggcaacagggtatgcggaacatctaaaattctaaacggaaccaatatgaaacatc

SEQ ID NO: 429 - DNA, 9835 bp, Unknown
  derived from dsRNAs of unknown virus
gaattttaattttaggcttataaagtctacaagcccgcgtaaatacgcttgttcaattttaaaattccagtgtaaagcgagatcggcacatacgtgcgtctgacaactttagactgaaactcgttcacgcgaaggcgctgcaatagcatgtaggttaccactaagtggcaagacttggctattagtgagcgcgctcggaagaacatcttgattcgaaaatggtggtgcgcggtccattctagaaacaagggactacttcgagaagacacgaaatagctgaacatcgaaagggagggagaacgtaggtcagacttgctcttaatctttcgataattaggtaaaacttcgttccataaatggcaatttcgccacttctaaggagaaacttatgtctgcattgatcggagatgttcacatttctcgctctgtgttcaaacagattgaagagattcatcaacccaacgacactgtgaggcctactgccaaacagatcaccgacatgatgctcaagaatgtagtgagggcgtttatcgacgcaaaagtcgacgaacacaagtacttcgatcctgatcttttccgggctcgcaaagtacccggagagatgaacgactacgttatctatccgaaatacagtggggtggcggactggatggaatccaggttcaccatacccgttcgagtggtaatcgagccgtccaatcgtcacaacattattgatcgtgacaacatcgatagtatgaagtctgcacaaaggctgctattcaaattcggactgtcggctcgcgcgagaaattgtctctttatggcggacgttttcgcacttgatgaactgcagaatcttactgtacaggagttcgttaatacaccaaatgtggggcataaaacgctgcaggagatcaaacaggccatgtgccgattcgatattccgttctcgaaggagagaaagtacgtacctaggcgtactagcctccctcacaaggatatcaatggtctctgcccaacatgtggaaacgacgtcggacatggcacgtgtagtgtctcgaaaattgagggaatcgattgatgaaaacctcggcattcgaagaaatcatcaacgtcatacctggtcgctgcttcgtctccgacaagcggaaccaattgggtcacgacatctatctgaatgtcagatccactccgactgatcttcattttgtgcgtcgtttcaacgacgcacttctgcacgtgtactgcgaagtctcgagccactcggacatcgagaatcagtttccgacttaccaactaggtaaagttgaaattaaatacacgtcgagaggtcaatgcccgaaggaggtacgctcagcgacgaacgccgagcgattaatcttcattatggctaaagacacgattttcaaatccttggggattttcgcatgactagtcgagttttgcatgaaatatctgaagaacacgtagcagagattatctctgctggcactacgaccctctttgtgaactcaggcggtggtgatattaactctgcacttgttttgttacactattgtgaacgtaatcaagtaaaggtgatcatcgccggtcagtgctcatccgctgcctgttatctcctcgctttgtcacgccataacgtcgagataaagactcacgcatacggcgtgcagcacgcaccgtcaactctgcgagacccgcagaataactggcatggtttcgatgattgtggttttaaggctgctcatcgacagtggaatcaggataagaaggtgtatgaagaactacttgatcgcgagatcagcgatctggacgctttcaccctattcgattaccatctcgcaacactcgtagacgagggtaatctgaggaaaatctacttcggagatgatgtatgctagttgtgcattgtcctcccgcatccgggaaaaccttcctcaccaagaaataccctggtgttgtttacgacaacgatgaccttctggaagacatcggactcgaaagttctcactcgggttttcttgccatccaggatagtaagaattggcaaacgaagtggttggctgcgtttaacaaactggaaaatgacggcttcaccattttcacaaccaacatgaatgtacaacacctgtgtggtgtgcagatcaatctgcgcgctgcttacaaaccgacggactacattcgtcacgtcgaaatgagtggacgtaaggacctcctcctcaatttcggtttcgacgaactgaaatcttggatgtccgactacgtttccgccgaaaaggagttcggtcttaaggtgcactggatgaaaccaggacacttcattgacgaactgatcttttaatctgaccgaataacatcaacgaacgggcatcgcccgctctgcggagaaaactatgcaacacaatttgtgcacaaccgttttcacgatctcgtatttcgtcgactcgtacagtcacgttatcaaacatcatgactctgtagcacgcaccagctacgaagccgagatcgaagtaatcaatcacgtgttcgatgaattcggcaccacacccatcatcgttttcgttgtcgaccaaaatggtcggcactacaacaagggggtgaaccgtgtcgttatttgagctcgaaagagacacctacgtcagcctgattgagctgcttgaactggtcgtgttccaacggaaactccagtttccagacattatacgattgcagaatggctgccatccgattatcgatctgcagtttaccgactgcgggcaatacgtcgatatatcctggaggccgcatgcttaattacgtgtttaaccacgcctttctcgtcagcgttgctggcaacggagaggatttcgtgttctacgcgcgactggataatcaccacgtcgctcggttcaactggcactcgtcggaacgaactgcgagcgtagaagtacgcactgaacgtgtgctcccacacgtcggtgacgctgttgtgcagctaccactgcaccaacaatctgtcatacgacgagtaatgcacatctattcacaacgtttcactagtaattcggtagcgaaagaccacaatctgtgggttcgcagcgccggagattacagtgaaggttcaatttacctttggatgtagtatgactaagcacgttccattagtatgttgtttggacaagaacgcggtacccgactacctcattcgtgaggaaaaggagcccgcccccaacttagcgacagacattttaaggaagtttctcgatggtactccctccaacgaaagacaagctaattcacaacgctgaattaggtgaggcgttccacgggccgaattccgtcccgaaacatattctggaagatacaattggtaaaggctgcgccaaagtactcgtccggaaggtcaacgccttcaaacgtttcaaatccaagtataaagccttttcttggatagacaacgacaccgttttcgataacctcaaccatgcccgattcgagctggaggacatcgatccacggttcccatccgtggtcacacacggagcattccgacaacaaggtgtaggagttatccctccaaccgcaccagctcgccgagaattggggcttatcgatcctgatgacgaccatcagacgatcggcggtgaaaagattgattcactgttcaacctatgtctagatctcgtcatcgacgaattgagactcggacctatactggcggagcagcagcaaggctccgacttacgggcacacgtcgtcgtcaagaaaacgtcgatgaaaggccaccctatgtgttacactggacaggccgcttcggtggacttttcacgcgacgtactcgttccgatgtacaatagcaaggaaggtccttacactttcgcgttcaaagacgactactacatcaccctgggaagccgcgaccaggcggcaaaacaaaaattcaaggatggtgagtggtcaacgtcgtacaagttaggcgcgagattcgacagtaaggacggtaacgcggtatacatggcacccatgtatgatcccgatgataacattggcaaccgcgtccgtcatgtcgcgaacgtcccaatggttgttcaactgccgggtatgaccgctaacgctttcgtgttcgacaatttgacacccaaaatgcagatgattctgaagcatacacccgattcgcttcagaccgtcataggcaacatagttcatgcgacggatttctcatccttcgacaaaactattctacggaagtcgcggaaccggttttacgatcgcatgtactcttcggacaacgcaactctcgcgaagcagattgacagatatccgttcgcaggcgtgtatactgagcacgatgcgacacaaggcaacgaagatggtacgataccaatcttctaccttatcgatagaacaaaagatgatctggcggagcttttctctccgttggcgtctggcacgggtgacaccgcactgatcggtaaaacgattggcacggctaacttgttgcgagttctgtcaatcctcactaacacacaccccgctaaaataatagcggcaggagatccaaacgcaatcgattgtctagcagcccaagcgattcgtaattcgggcgatgattctcttacgatcatcgaccccgtcgccaaatttgccggtgtgaaaccggaagaaatggccaaacgtcacgtgcatctgctcgagacacagtcgctgttcgacctctcccttgaggtaccagcgaagttcatcgggtacgtgttccacgctgacaactccgtgacgggacgttgttgggcagtgacacacgacgtgacctccctgttcgcaaacaatgttttccgtgaacatggtttcgactctccactgcgttcggacgaagtggtgggattgtcgcgttctattctcgcgtaccggtcgaccctcgacctagttatgcctgctgaaagcgatcgtcttgtcagcacactcctcgacgtagtagaatgtccttatgacgaggaatcgttgcacgcggagggcacggaacgacttgaaaaccccgagaagtatcttagtcgacgtgtaaatgaagaacttgtcgaagaggatgacgattgggacctggaaagcgtttccgatgaaatgaaagccgagtacgcaaggaccaaactggctgaattcttcggtctttcgaaaccggatgaactagactggaagatcgaaaagaaacggctcattgaggaatcgccacccgatcttctgcagtacatcgcaattgtcgtcgatccgaaattgacgactggtgtatccaaattcattaatgtgagattctaattatggcatttgtagtttccaacctctcaacaactatggccctcatcgacagcatgctgggttccgtatccaacagtggccgtaaaactctggtagccccactagcaatccagcatcatcttgcccacttcagtgagcacatgcaacttttcatcgacaccatcgtcgaaggatatcgtggcgcatcgacgtcgaatgtcgacaactccgagttgctacgcgctaccctgaccaaccatattctcgaggtttactatcccgagattcagaagttagcacctctcattgcctcaccgaccaatctgggtgcgatcctggaatcccatgatcccatgtgggaggtagaaaaaggggaggacttcccgttctttaaaacagtacattttccgcaactgcgtgatttgcacgcgaacatgcgctcaatcctggaaagtgtcgacgtgactaacggtctgcgttacgttccgtcgtactatgcacccaagctgtacgcacacctcgaaaaggaaatgaagtcgcgtcacagtctcaaccagaatagcaagcgtatcaaacagctgggtgcgcttcttggttcggacattactgaggaagagctgacacacatcaatcaggcactgtcgcgtttgtttggtgagctcaagaagctgtccgacgctcacgccgtcaccaatttgtgggagttgatgattctgacggatcgtgcggtgtctgacacggatcagcccatgttctgtgccaccgacgtacacatgcgtcttatgcacactgcgttgtctatcctgcccactgaggtaggtgtagacattccgctcagctacgtgaacaacagcgatttgcccgaagaggacaatggtgttacccgcaccgccgacgcggtcgacattgaagagggtgtttccccgatgatcggtgacgtgttcgaacacctcctggttatcgtgggtcgcaccgcgaagcgtatgtccgttcgtctgaatgacatcacgctcccggtgaacatccacccgatctcaactataatcacggatatcttcaaggaaggtatgcgtgaactgctgccggacgttcaatccgaatttctgggccgctggttggatcttgcttcaaagggttcaaagactcccgtcaaatatgacgacttcaaagtcaagatggataacgcactgcacgtcgatcgtaacgcaattccgcgtgcgttcgacgaccatctgtttaagatggtaggttcactgcccgaggagctgatccggaagtacgttgagaagcgctcagtgtatacgtcgatgatcgaagccccaattgagaggacgttgctgcgtgtgaccgacagtatcgatgagatccgtgacaccgcgcgtgtccgtctcgaatccgatcaaccattcgcgtggtacggtgacaaggtaatccgcaaacaaggttctacgaacgaagcattcgttctgcggagcaagatcgactcaaacatcgccgtagacggcgagatggcagagggtgttgcgaaaattgtcgccgagctgtacaagttgcgccaacccgatcgcgacgacatcgataaggaattcagctacgctgaattcattcgcaatctccgtcatgacctgggtgatgttcgtcgtatcagggacattacggctaatggtgacaccgagctgcgtttgtcaaacgtgttacggggaggtgaatttcagtacaaggatgatttcgtcttgttccgtgaacatgggcacagtcacgaaatgtccatgccccgcactatgatcaggctgcaccaagattctattatccatgactaccctaacgggagtgttgcgtatggaaccatttccggcatgctggcgagtgatctcttctctcgctgggccggtaccattacttcgttggcctcacgtgtggcacgcgtgtactccgctgcacctttcgcagaagtatcaaaagatctgaatattgtcacgcaatatcagagcacgtcatatctaaaacggagcaccgaattcagtactttctactctcagatggacgtcatgaccgacgacagcgtgtggcgtttcctgtctgcaatgcagacacagaaactcgcacgcgataaggtcgacgtggaggtgctagagaaactcaaacgtcacgaactgtttgtcaacacctcgttgttgaccgacattgccaactacgcggctagcgtagcgcaaagtgtcattgataacttcaatgtcgaatcagaaggtttccagacgtttgcgaaattcgtcgccggtcgcttgactgatgccgaaatgggcaaaatgcgcgatccgcgcgttttgacggttttcaactctctcgtcaccgtcacattcgaagctctggagaagaaggatactattatcacgctcatcctgaccaaggcgcttatgaacgaaatcactagcaaggtgaaataatgaacgaactggcatcaatttcgattgaaaccatgataccgcgcgctttgcgcggtttcggtgccatcaccgtctccggtggtggtggctccggtaagacgtcactcgctcgggccatcgggaatgacctcgaggacccggcttacaaactgccttttgagtttgctaaagccggtgcactgttggggtcggctaagctgtcctcgaccgtctttgagttcctcggagtcttcctttctgagggtggacgcaaagtgctcaacgccgtggaccccgatctctacacaacggcgatgactgatcttgagaaagtggcgcctgagatccgtaatacgattcgtgtcgaagtgttccgcgcaataagtggagccttggcgccggagcgtcacctgacggctctcgcaatgtcgttgcaataccatatcctccgggagatgggtacggtgaaagacgtacaacccgtgaccgacgacgaaaccatcagccaaatcatgaagggtttcgaagacagtcagctgactccacaacagattgaggatctgcgaaagaagtttaccgctaactccgacgtcgcaaccgatgaccgttcgtcaatcgatggaagtctgggtacgtcacaagcggtgctgaaatggttactggacagcatcggtgacaacagtggcgtgggtgttaacgcactcgtgagttgggcgcttgaccacagggacttgatcgttcctttacaatccaacgcacttatcatgacctacatggtgagcaaagtggcgatacccattgcgactgcgttaaatcaacggtttggacgcgtcgtggtcatgcggaacgaaaagatgatgcgggatcgtaaactcgaactcgttgtatctaacgagagcagacgtcatgtgttgatttctgcgatggttgacggcgtggagatcagttccacactgacgttcgaacctatcacggtagcgcgtggtttgtcattcgcgttcaatgttcacctgagtacgctgaactcagcctacaccaggcacatggaatcgacgactctgtctggcggtttgccaaccgcaatacccgacgccatccaagagttgaacgacaccggtgccgaaattggaacgcgtttcctcatcgaaacacgcgacgatttcgtcccgaaacacgccgacgcggaggaaatggaaatgttccgtaaccgcttcatgtcctcgtctcgattctcgttatatctcgcggatcgttcgggtggtatgtggcgctcgcgtcgttacagtaacagtgatgaactgaacgaccaacagggttcattccgcaaccacttcgacacatacgtcgcgccgcgcctcgtcaatgaggagcaggggcaagacgtctgggccgaattgttcgctatacaggacaagaaatgaatacgactgtccctgataacgtaaagttacgaccgactaaagcggttgtagctgcgttggcgtatcgtctgagggaggaatatcccctcggacacaaacaggccctcgactatgtcgcgagacgtatgggttacgagggttacgatgactatctcgcaaacagcggagtcaaagatgaccgataaactcgaagaactaatacgtatcaagaacaaacactatgacacgtggggtgattttaaggatcacgtcagtgccatcacgcaaccgccgattggtgtacatggtgaacgtgaagtcggacgttacgcgtctatcgccacggaaaccaccttcggtttgtcattcactatcagtgaaatagacgaggctcaacgtcatgagcaaaacaagcgcaaacccccccgagtcgcaaaagtcaaggcagaacgatctgctcggacagctgcaaatcgcgatttccgcgctcggtaactacacgacacgacgtgcccgcaacgacattgttgaggggtacgttcgtatcctgctgttgacaagcggggtggtattcgtttcgttgagcagtttcgctgtatatacgcagttcataggatgaactacgttcgtcggtacagacggatatgatggtatcgtgcaaatcgccgctcgagcgatatactcgtaaacctcacatatttattgaattttatttaactgcatttgcagtcgccttattaaaggcgggcccctaggggccctttc

SEQ ID NO: 430 - DNA, 1809 bp, Unknown
  derived from dsRNAs of unknown virus
gtaatttattattcataaccctatgaactccgaacaattttctaaatacgaagtattctattggatatccggctttgtgctgcgacgcatccttgtgaagaccgtgtttccgacttatggcctagcttcttatgagctgagcaaggatgtaagcctactggttgcaaaagtccttctggcaaaagtcatcttcccttcgcgtaccgacaaggagaatggtcgaaatggtgccccaagcggatctattaacccttatttaaatgaacctgaagatggaaatccgcagaattgacactctggatcttaaaccagaagtagacagtcagctttcccgaatgatgtctaatgttgttcaaggtaacgacaacataattgaaggccccctcgctaaagtacctaaaattcaagaattattcttggaatggtttgaagcgatgcagctgaaagaggctttaaatgagacacttttagataccgaacgtgctaatcaagataaatttggacccagatctatcgcattgccttggttagacaggattcctggtgtgaagaaatattttgaagtcgatactactctccttcctgatataactttaccgcaagcaccagaagggcgattacgaccattgacccttaaaactgcttctgagtatattaaaagaacgacaaattcaggattgccttacttacaaaagaaaggtgtagttcttaaagaagctttagctaacttcgaacaactgttgtctcgtcaagatccttgtgtattattcactcggactcaggaaggcaagaaaactagacctgtatggggatttccttttgcagacactttatttgagatgatgttctatcgtccgctactcgaattccagaagaagagtggctatcgtgcagctgtagtaggacctgaagcagttgacaccgctgttagcagactgatgaaatttgcatcagagaacggactaaagttattaagcattgatttctctgcttatgacacgtctattcgcccggaattgagcaagatgtgcttcgaatacatcaaacgactttatcaagcttcacatcataaggacatcgattacatttatgatagatttgtttcgataggactttgtacacctgatggtatttataccggcatgcatggtgttcctagtggtagtacttttacaaatgagattgactcacttgttcagtacattattgccatgaactatcctcatgagaagcttgaaatgtttcagattcaaggagatgatggactctacgctactaaggatccagagaaactaatggattggttcattcaatttggtctgcaacctaataaagagaaatctttgatttctgatgacgtcgctcaatatttacaattgacatatgcacccgagtatgaagtatccggcgaattcaaaggaatttatagtgtatcacgagctttcaaccgcatgtgctacctagaacgtttcacagattttaccagagatgatattgatgggaagtcttattttgcgataagatctatttctatccttgagaactgtaagtatcatccatggttcgaagaatttgtaagatttatcattaagcacgataaatacgacttgcaagttagcgatcagtcaataacaaactatataaagttaagagatcgagaggacggacgcgacgttaattttaacatctatcagtacggcgattatgctcgcggactgaagagcttcgaaagctataaactagtacgacagttaacgtaaatctctcgtaatacataggttctctatggggtcagtgagtaatcacccc

SEQ ID NO: 431 - DNA, 2096 bp, Unknown; identical to SEQ ID NO: 303
  derived from dsRNAs of unknown virus

SEQ ID NO: 432 - DNA, 2464 bp, Unknown; identical to SEQ ID NO: 304
  derived from dsRNAs of unknown virus

SEQ ID NO: 433 - DNA, 2131 bp, Unknown
  derived from dsRNAs of unknown virus
gaatattatactattgagataaataactgaaataaaatactttataaaatattaataacagcttaatctttattcatgacgatcgttaatgataccaaggattatgccattaaggtggcatcaactgcgctaaactccttcgaatcacaagcgcgtggagatatccaggcaccgaatggtgatgacaacgtgagaatgtataccgccaaaggtggctcagcggtcactctgggcagtagcacaacgagcgccaccgtcgtttttgatccagaagcatccattaggcaaggccaagctagcgttgtcgtctacggacgtaactcttccaatgccgtcatcgaggttcagcgagtcacccttggtcgctcaagcgacgaattcctgtcagttggagttctaagctcaggactgaaagttttcaactcatctggtgttgacgtaatcggtggaacgcaatcggcggccgtacttacatcagttccgaggaatgtttctattttgtcctcgactgatcttgcgaatgcatgccctaatcatgagcgtgatctagccagtggcgttgtttcccgcgaggaatcgactatgacgatggctatgactgagcatttcggaaagaagatggctctatctaggagcaacacgcttggtaacattattaagcgcacgtgggatgatggtattggcactaggcgaaccacggccggcgagacgctatcctttttggttgatactaacctaaccgctacgacgactgacctaactgatgtgcaaatcttgggcacgcccggtgacccgacaagcactggaactgcgactgcccaagtactggactccgcgcgtttgagtgaactcaataaccctctaactctcgcgacctatcatgctgaaattgaaatgtacctggatcttggtgatcccggatcaagtgcacttgaaaacacgaaattcgagttcaagttgtacgccctggacgctgcggataacattattagtgttcgacgcattaacaggcgtgaggatcttaggaacgcgaaatcctccggtgtaactgtcactggatccgttacgagcactacagtgccaatttcgagggttgtcgtgggacttgtggttgttggtggagctaatgtgaatgacccccttacagtcgttaacacttcggccagactaactgcgtacgaagagactgcagacatcgccgctcgcccaattcacgtttgcgtgttcgaaggtcttaacgcttcggcgaccattaaccttaactccacggtagtgctcacgggtgtccccgactcgaccaacgttttcatctctacggctcaatcgggtgacgtgcccgtgtatgacaccaacgccgttgaagtgttcctgaagtcggtgtcacgttccctgccgcgagcgttcacagttagtggtcatagtgcagtgtcgcgatcgcttgatgccttctatggtgatgaagcggtctcagtggccttcaaagctatgagtttttccgatgtgcaaaagggagttcaacacgtggccaagcttgcgaagaagtccggttctgaactttctgatgctcttcgcaagctggagcctttcatgcgatctgttggtacgcccatgtcagccctgcccgggccagctggtgcgcttggcggaatgatggtcgctggtgcggactatggaaggatgatgcgatgaaaaattgggtactttccaagtgtagttcaaacgcctgatggatataagccaggtagactgcattcaattattctcagcgacatgccattgaaccgtaattattacactaagggcgtaatccgtattgatgagaatctaagaaacatcggtgacgatattttaaacatgatgattgacaataatttaaaatacgcctctttaaagaataataacgtagtagaaggtaggtcgtgggaaatggcggcagcgaagagtatgttgaatgagaagggagtctactccggtgaggtaatagggtatgatgcagcgcatggaccgacatacggtaaagtgccagcaatacatgtcaaaagacaagtttataaaaatgtaatttcagtaatttaaatcaaaacatatgcgtcctttcccgggtcactaagtaaaggtatatgaaaacatc

SEQ ID NO: 434 - DNA, 1725 bp, Unknown
  derived from dsRNAs of unknown virus
gtttaaaatacacatttcaacccaaaattgataaagttatttgttactaattaacaaattgatataaatggatatcacgaaaatcccgcaatcatcattagaggcttttctcacacctgaagcccagatacgtagttccggtaatttcgagcgtatagcgacaggatctaaaccaacacctcgttcgcctttgtacaaaaagcaatcagctatttggattcaggaacgttggacagacattctctcgtcagtagctaaccaagatacggtcggattaataacctacgattctactagatggcctaaatttggcccgcaaggaggttttccgcctctcagcgatcgtatggaagatctaagtgcatattacgataacccggtgaagatcgagtcaactctgaaatatacgaaccctactcggtactggaaattagttgaacaggtaagatcagacctgttcggatctcagagagacaaaagacctttgactccacaatctgtgattgatagagatagaaaggatggaaaactaactactaacagtagttgtcccgactattctaaaagaggcctgccagatgtgatcgctaatgcagtggcagatacaataaatggaaaatggaagacttacccaatgatactgggctcaaggtcacaaaggggtaaatacagatttatattcctggctcctttttcattaaatatacgagagaagatgtttctacagcctttaatggatggaatcagaaaacacggaaatcctgctttaagtgcatgggaagggtttgatgatgtagaagcagctatgaatcgccaacagtttttcaaggcgaaacgctttacagcgcgtgattttaaggcgatggacactacatgtggggaaagtgtttttgagttcttttatgacgtaactcacgttttctttcaagctacatactggagtgacttgaaagaggtaatcatgcatgggattagtatacccgtgatgatcagtcttgacaaactggtaaccggtaatcatggaatgttatcaggaagtggacttacaaacattatcgaaacagtagtaagctatgccgttggtaaactcattgaagagatgataaactctgaacttgtaggagaccaagtgcttggtgacgatggtgccttttctgataatgcaacagatataactgatgaacaattagccaatgtaattagagatgcttctttattatttggattagtcgcccaaacggaaaagcaaatcatttctgaccactatacaatttacctgcaacgatattttactgagaatatcaaggtcaacaacacctcggttgtagcaggttgttaccccagcgtattagcactgaactctgcggttaacccggaacgttatcacgacccaagaaagtggggatgggagatggaaactctcagatggatcatgatacttgagaattgtaaaagactcccgtattttaaggatctagtaaaatttgtacaagaaggcgattcttataaattaggtgttgaaaagccaggtttcctcgataagggtattaataaaacttatgaagaagctaaaactattacaggtttcgtaccgagctacaaccaagctagtcttgatcgaggcattcaagattacgaagttgttaaacttttacgaaacggtctctagtgttagagatagtttaggttctcttagttgaggtaaaaagatgaaaatcttttcct

SEQ ID NO: 435 - DNA, 2089 bp, Unknown
  derived from dsRNAs of unknown virus
gtataaaacatatactttaaacactattaaattagttttatcaaaattttctgttcgaaacttgcatgttagaccagaaatccatattctgttgctagtgtcgtccaagatacactaagtcaagtcactcaacattacatatattaacataggaattaaataaactatggaacgaaactcattagatgatatttcatcaatgcgaggtggattcatgatcaaccctccgggtacatctagaatcccaagaacaagaattggaacaaacacaggcctaccaccagctcaggaactaccaactaaagaaggtaaatctgtccctgagtcggatcttagaactaaagcgtcttctaagactcaaacaaaaacaaaaggttttaaacaacctacggctagagccacgaaaacagctcaaacaaagagctcaccaagtcgacaaaaatcaggacgttcgcaatcgcgtgccactactgttatgtcggccggtagatcgtgggttggcggttacggcggtaaacctccaggtagtcccgaagaatccggacaaccaggagatagttttcctacaggtgaagtagaatacctaggtggaccacgagttactactcaaacctcaaagttcgacggtatatctgaaatcgatcaactagaccagaccgcaggttcatggactggagatccttctcaagtaagaacactttatcaatcattcaatttccaaccatatccgaactacggcggtgcaatcgccggcatgaagagttcaggtgcaacaacgtttgcaacagcctcaactactcaagacgagatatttttggatacctttggtgctattcaacaggaatacagtgaaaattacaatgctaacacagtatttgaacaaaatttcaaaccagtgtatttctactattatcaatttgatgttaatagattacatgcagaatatgtttgcttattacaaagagcagcatactatcaaagtaccggcactgagtatactgagaatgcttgtgctgaaaagatagcaaatgtattgaatacaacaaatttctatcctattcgtaataaaatggcgcgagctttaaaacgccaatttattgacagagagatgcgagacaagcattacgaaatctttcagactaatcgtttaactccacacgaaacaggtggtacaatctttaatgttaccgatgcaatggcaacattattacagaatttatcaaacgccgcagatttagcaacagcgcaaaatgtggttgcaacttatatagctcaactggatacaatgtgtgactacttactttatggtcgtcctattcagactgatacttcagtgagtccgtcaaaaacaattccagactacatgatacctaaacgtgagttttcgggaacattatacaatttatatactggttccgaccctgatactatttactcaactgttcgtagaaacgctatgagtgcgattcttgatcgagtttctggttcacgaggatcatttgactatgttaaattaaattaccaagctcgcggtaattcaatgtcattatacgactcagctttctgtgatcgttataacaatactccaaatcgaaatggaagtacgttctaccctacaatgttgaaaggtagtactactgtgtcaaaggcggctctttcagcatcgccgtactactgttctgaacgtagtgcagacaaccaagattgtgatactgtattccacatgttattaatgtttaatggcgaatccccattatactattcaaactcgagaatcacaagtttcacaacaagagagtattttatttaccgaggaagaaattctttaattggagatgaaaacattgacttagcttacacagctaaaggaaacatcacccaagtaggtagtaatgcatttccaccgattcaagataactatgttactaaaacctatttcgatggtagtaacatttatggtttctctgctcctgacggagacagttcaccattatacttcgtaacttacggacgagttatcgagaaattcaaacaaaagtatatggttaataaataactacatcgcctgaaaacatcttgttttcaggtc

SEQ ID NO: 436 - DNA, 3577 bp, Unknown
  derived from dsRNAs of unknown virus
gtaaaataattctttccttttcgaaaagaactatgacgaacaccgatctttccagattaggttattttacatccactcggttctgtggtttcgtcactatgcatggagaactaatatatatgacagatttcgacgttgctgtgaatcagttttatgaagaatattctaaatatgcttctaatctaaatcacgtcacacccctatcacatgacgactttaagttaatcatgtcagggactgcaagctcagagacaatggaatgttttgaaaaagaacttcaccatttatctacgctacacgatgttaactttactcatcctaataatttaagcttcgtcctacccagaccaggacgcggattcggtcgaatgagctctagaacgggaataactactggtatcgaaccagttagtgatcttcttgacgttattaaaacagcggctatcaagcaaggttctaaaatggctacagatatggctcaagatgttatctctaaggtaactgataagatcgaaaacttagctgaatcattagggacacaaaatgaagtaagtaataatggtagctcagttaaatctaaagggttcggttctaatggaggtcgctcagtaggtgacattctaaacaaaccgcttaacattaaatattcgtcaggagttgtggctacagtttacccaccaagacaaaatttacctactagaaattacactagtacggataactcggatggtagactccgttccgctgatcttgcatgtattgtacaacgcgttccacctggtaatgctttctccgaagcttactggaactatacattaattcccaatcttcaacttaaggcgcaagcatctgtgggcttcaatatcagcgccagatttaacttctcttataccaagattgtaacatactttaatttagtaatggatgcattagctaagtatttcttcatggtaaatacttactctgtagtccaaggtcctggtgctgatgacgtaagtagatctgtcttacgtgagatgttccaaacctctgatttacaatatcttgctttacttcgtgaaagacttgacgcactacccatccctcctaagatgatagaacgttctgctttcctttactcttcttacaagtctaaccccgacagcgatgtctctaataatatcggttttgttcctgttccgcttattagttctggaaataatttcgtctttgacgcaattaatatggatcttgagcaaacggttgcaggacttggtgaattattagaacatccaaatgttgagctgtataacacagttgacatgttagctcgcgttttcccgaattgggttaacacgactgttggagctactcaggctgtacccgaatattctggagaattcactaatatcttcataaacagtcccggttggcaatctagttacctcgcaactgctccacaagatttcaagtttcctcaggtgtctggagaaaccgaaactgttcagttctgtgtttgtaatgaatatcgtgcagatatgattggtgaccaacaagctgcttgttccatctacaattcctcaactgcatcttggtctggtactttagagcctcaaatctcttcgttccaagaaacagggaatactttagtaactaacagatacacttacgcatttgattcaaactctgctgctatgcaacaggcacctgcttgggtaccttcaaacagagcaagcaataccgttagcggtttaggagttttagcgcttagccagccttatgctaattttgtttgtggttcagattcttacaatgttccgccttttagtacttacagtctaattggtaacagtgttagtaacatgtctcaacctactattgactggatgaaagaaatgtttgatctaggtactctaactcaacgagataatagttcacgccgtcctcgtcaaccaagacgtgataacggtcgttctcgttctaacgacgcagagacgtctagtagctaattcttgtaaggagtagatttatgaagcgaagccgcacacttgatcaagtttctaaaatgtataatttaaactttactgagacagatgaactgtcccgcgtacttcaaaggcttgttaaaggtagcttagactctcctaatatctgtagtcctgtaatagagaaattaggtgaagcgaaagttctagatggttgggacaaggttttcaactctcacaagtccgaaattaatgatacccttctttctattgagatgaatgaaagagaaaaattcgggagtagaagccgtgcgaaaccttggcgtgatatcaaggataagttcttcgacttttggaacgttagttcaactccctacaacctaaagcctctcgaacctgaattgaaaagtagacttagaccatgggatataaagcgagtgattgaagttattaaaaatagcactcagtcaggacttcccttcttagtaaagaaaggtttagtgaaggataaattcttagatcaggcatacttacttaaagagtggttaaagaaatatgccgctgtgccttttgttaggactcaggaaatgctgaaaactcgcatcgtttggggtattcctatcgcgaacatcatttatgaaggtgcttatttttaccccttccttgagtatcaaaagaaattatcctggagaaaggctttacttggcccggatgcagtagatgaagttgcctcagctatggttgtcaaagctgtttctcaaggtgacctacttgtatccatggacttcagtgcctatgatcagtcattaggcccaaatctgcaatctctctacgatgaatataaatgcagtgtatttcaacctcaatattgtgatactatattagagataggtgaacgtcgtgttaacattcctatgataacacctgatggtcttaaagaaggacctcacggattacctagcggatcagctgataccaatgaagctggatctgttattcaagccactatagctgctgacactgggttgattagcctaggtggtgattcaagtcaatttcatggtgacgactcgatagcacgactttctggcaaggaagaagtggatacttacatatctagttttgaacgccttggacttgaagttaacaggactaaaacctttattgcaagcaatttcattgtgttcttgcaacgtctttatcatattgactatattaaagaaggtaaacttggtggtatatattctgcttacagagccctgaacagagtatataactttgaaagattcactgacttcgtggatgagaaaattgatggtaaagacttcaattcgattagaacaatcacagttctagaaaattgcaaattccatccattattcgaagaaatagtaacttatgtttggagtctagataagtataatcttaaattttctgaaaacggacttagcaagtatgttgtgatggtgcgacagtccgagggtacagatggccttattcgtaatcagtatggtacagatgtttcgggtattaaaaatttcgaaacgtacaaactgttacaaaagttaaataaggagggataaaacctgggagcaagcctttgcttactcctc

SEQ ID NO: 437 - DNA, 1890 bp, Unknown
  derived from dsRNAs of unknown virus
tagaaaagtaatattttattttgtccctattatcaaggtttttttaaacattcttccttttaaaatgtaattactttttaggagacctagggtactagtttggatacgtcatcctgtaattttagtgtttattagcacaaatgttttgcttgttttcaaataaaactcgtagtggttgactcttctaccctttaaagttggtcggttttgttatccttatcaactatatcttacattttatagatgcatcattttaaaagacttaagtcttcttcaccttctattttatcatctttctattcgtggtcacacgaacaattcactttaattactttctctcgaactagttatatttatgttcttcgtttacttcagattttccgttacattttagagtatttccagacctccgtcgttcctggtgctcgtggtagtgtaggtaatcaagtaatcggttccattatattctatttcttactcccgttctttctattgaataatcagtttcgtactaattttaacaattatgcaagttcaaataataatttcatcttgtctaatatgtggcatatttttcagactattttagctgatttttatgtaacggatcacttccgtaagattgtatttactgatgttccatttgtacagattttaacttacctcgttttctctcctttctatctctttggatatggcgttagtttagctggtgaacataataatgttcctaatattgtttttaatcatttactgattttagtttctatttttagaaattttttgaagttgtcattggacgatctttcaattgtgttatataatacatttagtggtaaaaaagctattgatgctgaaaaattcagtttaatatttgttaaaatatcatctaagctttgatatggtttacgtcctcttgaatgtgacatgtcacgttttatcttaactatttttttatttatcatgccaaatgatataccgcgtgttattgaattagttttaaaagaacatcttaatgatgattcatcacaacaagattatatgtttcattactttaacataattattgatttagctaagtcaatttgtgctattgttgattgtcgttttaattttaaacaggtgaatattaaatctatttttcaattaggttcccttcgtttattcggtttcctatataatcctttttcacaggattctctcggtcattcatatttatcaacgtgtgttaaaggtttaactgatacagcgttatatttatgttttgttcttatctttggtatttccggttggtctcaaactcgtaatcgtgaagtttactatgattctactggttattctctttttgatgctgatttgcgtagtctagtcatgttattatgtaagtcattattcatcgaagttgttacacgaccagctggcggtacacctcgtcctaatagacgctctaataattctacaaatgattcagatcaatctgacctgagtataactagtagtaacggtacaaataacgacaactcttatagttcatcaattttaagtagactatctgcttttgatctattagaattaattcgtaatgaaacttttctttctttaattagtgatcctgttcggttacaaattctaacccagtcacaacataactcaattattgatgattagctttctaatttgatttatatccattcattatttcttatcttgatttgtttatattttaaactattttatcgatgttttcttcttcttttatttgttttgttatatgaatttatttatctgcatattgcttgtatgaaagttttaattaaatggtttgatcatttatatatgtaagaggtactgttaatcaatctacgagttcacgttaactcgaacgtaccc

SEQ ID NO: 438 - DNA, 700 bp, Unknown
  derived from dsRNAs of unknown virus
gagaagtaaaagaaatctagcctcgtcgaatttcctcacccagtctcccgattacaaggtattagtgttgttgaaaaaaataaaccagaaacgacagtagggcaaaaagaaaagcacattcgacactctttatggtggaagagtgctctagacctttttaccccgggggtttgccaactcgaaggcccacaccctgcaccgattcgcaccacgatgtgctcagtcgtcacacacatgtcagcaataggaaaacttgtagtctcctatatctgaccaatgtatgaaaaccaagcagtgatcgcagggatagccgaaccacacgccgcgcaaaccaacaatcctcgttcaagactcttttcaaatcttatcatctgtgactgtcagctaatcgcgattggttccaagcatgcaggatatgagttagccggatgtccgaacaacatcttccccaccgatatgtttgatggcatacatcaacagggcgatgcctcgcattgccttgttttgcacaccatgagggacatatcgatgagcagacacagtctttcaccaggcgctacgagcgacttcctgagatactctaactgatcaacgcgctgattgtacaagtacaacctcgtagcgctcctagcttcgaatggcgaaccccggtttaagtcttcatctaacacagtgacgggcttaaatctctcatctttcc

SEQ ID NO: 439 - DNA, 1508 bp, Unknown
  derived from dsRNAs of unknown virus
aactttaattacaaaatttcctatcagcgattcccaacaagttatcgctaataccgaactccttataacccacttccaacaacagacagtatgtccgaagaagagactacccttcccccagcctcccgtaccaagatcgctacagtcgcagccagactccaagcagacggtactatcatcaacggattcgcgaatgatgaaccagctattaagagaatcactatcaaagtagacgctctgctggccttcctcaccgccaccatcacgcctatcgtttacggtaactaccgtggactaggtgtacgttctgtcactgcaacatctgacgtcgattatctcgactcagtcatctacacagtcgccaccaacgctgtgcaagcatgctacgcagttggattcaccaagacccaaaaggttaactatggttctgttcttcattacggaggacgtcccgaagttgacaagtttacgatgcccgctctaacagcgctattcattaactctttcggtcccatcactcgagctcgtgaatcctatcgttgcacttttgttcctatcctgaacaaaactaacgtcgacgcacttcgtgccgccgttaaatacgatccccgcaaagaagagatgttccgtctctctatgcaacgcgctcattattctatcacgatgtctgacattgacatcaacaatgaagaatcttcccactggtggacccttcatgtcgttcaaaccaccccttcaggttttaccgatcccacccaccaaaccgtttactcccctatcagtttcactgatttggacaacgctaccaccctagctggtgctatccttagcgctacgctctacgacttccccggcccaatccacaccgccagaatcggcccattcgtcactcacacaggtgcctccacgcctgctgacatcccagccgctcttcgcgatgacatcggatttaacgtgtcacctccagttcgtcttttcgaatttgaagcctcacgccccgccacccaagctgacgtcattgcttttggaccaatccaaagcaatactgccatcaccaaccttggggacccagttctacgcaatccaggtcaagcactcctcgacctcgacactgaccaccgcaacttcgtccgcaatctggacaaatggtatgccagccaagactcatccaagcaagcgaaatcttctgccaactctacgaccatcaccgttccaacaggcaacaaacgttctcgctccatcgacactcgtcccgaccctgtctacgcaatcaagaaaccttctgatcttgccgacaaagtcaatggatatagtctattcaccgtcaaagtctactacttcgactgtgtcatcctcgacaacttccctctctctcgtacggaaagtattatcaccgaagcccaatctgtttaatcactgacaaacactaactaacccactagaaaacccggtttaaactccttttaatgatagataactaattcttataaaataagataattaacatc

SEQ ID NO: 440 - DNA, 1055 bp, Unknown
  derived from dsRNAs of unknown virus
gaatattatttcccgtattggaagttcgcgcggggaattctattcctaggttttaggacctagtgtatcttaatgtataaactgatattttaaaaatggataattcacttccacccgtacatgattgggctccgtatgaggactcgcttgttaggataaaacattcttgtttcgcaatgcacgaattatatcgtgaacgatacttgatcgccaggcggcgaatggtatattatgatgttcccatcatagtgttgtcagcagtatcaagtgtcttcattgcaggcggggagtcttatcttgataaacaaaccgtacaagtcacaacatgtgtaatgtcactttgcgttggtgtaattggcgcgttgaagaaattctttcgcgtcgatgagaaccgtgagcagtgcttagagacatataaagatctatttcgcatgttttgcgaattaagtttagtgattgacatgccgcagcacacgcgtcctggagatccacaacaattctcgaccgagaccgcaagcaagtacgccgaaataatgcaacgctcaatggtcttagaacatgatcgagttaaaagaaaccctatatatgatgattcacgtccactaccaattgagaagaagaggtcaatatttggaaagtcgaggtcggtgcgttcagttataagccaggagtctctatcaccaaaagagatggataggacactcgaatgctgatggtaggctcgaatatttgccctttcttcacacttggacgctctattggaccgctatctatgatagtttgtatgaatgcgtcgtttcccaccattaaattaagaccacggactaattagaaaactaattaaagcacgtggcatttaaactgagctggataagaaacagatttacgcatttattgtgaatctataattataagtgaaatattcattaatatatataataatatattgagataggtgttttcgccgcgccaacgttaatgtcgataacgttgttccattactttattctattggataagtagaatcgaggctagacgcgaaatatgaaaacatc

SEQ ID NO: 441 - DNA, 2034 bp, Unknown
  derived from dsRNAs of unknown virus
gaataaaagaagtacgacgaaataaatatgtctagttttaacagagctactatcaaggacgataccgagaaatacgtgggtgatctctgcacgctgattgcgaatccctaccagaagtccgtatccggcaaaatgacagccccatcctctacctccggagcatccatttatgtggctgagggaagtgggactgtgtcttgcgccgctggcactcgttccgctgttgtggtgtacgatgctgaggcttccctgcgtaggggacagccagcagtgctcatcttccagagggatagcactgatgcggtaactgttgtgagcaaaatcaacatcggaaggccttctaccgacttcctgtcgggaggcgtgatttcttctaccctaacgtgtgcgaacacctcgtctctggatgacattgccggctctcagacgcaagcggttttgtactccgtacccaaaggcgtgtctgatctgacggcgaccgacgtgctacagttcacctctgacaaggacatgcatctggtcagcaacatcagctccaaagcggataagacgcgcacctacggcatcactgagcacaatggttctaactccgctcttctgagagataatgctcgttcgaatcttgttgagattgagcacaatgtaacagcaagtacacaggcgtctcaaggattcattgctcctgccgttaatctggctgccaccaccggtagctttctcacgaacattgctaacgccctcttctattccaagagggacaccacgaagtctccgttctccctggcatcctacgtgggtcacctatccattaacactgagcttttggtgtcgagtagcgcagcttttgcggagggcacattgatctgcatcgctatggatgctgctggcgtggtactggattccgtagacgtgtcgattaacattacgaacgcaacggatttggttcagaatgagaagtttgacttcgcacttgatgtgaaccttacaagtgcgactgtgcctattgacagtgtggccgtgttcgtgaaagcctctggatccgctgtattgcagcgttcgacgggtgtaacctccggtcgcgtatccgcgacagaggagaccgccgacatccccggccgtcccattcactttacggtgttcgagggcctcaaccccagtgcatccatcaatgttcacggtgctaacatcttgtccggtacgcccgattccgccaacgcgttcatcagcggaggtggtggggctggagaggatgtgtatgattatagcatggtgaacaacatgttgcttacattcaagcatacattcccaagagcctacactggaatgggtgccgatattgcagccatggcgcttcgtgagtggtttgaactcgagggcatgtccatcgctatggaggctaaatccttcaagagaatcggcaaggcattcaagaagttgattaagggggcaaaacaggcgcgtagcactgcatcgaagattgctgatgtcgcacagcccatcatgcaagagggaggaatgatactagcatcgggtgcctttggccccaccgcgcaggtggcaggagcaggcatgcttgctggcgctgaaggcattgagcagtctaggagatatggtgtcctcgaatgaggggtatgccatttccctactgttgccactatctcgaatcgctggacactacccggtgatatacttccaattaaggttacaaaaggagcatacggtctaactgtgtctccattaatcagggatgtttcatcaacgatgaagatgttacttacacgcttaggtgtgagtaatgtaataatcgagagtgaatacgagatagaaggtaggtcatgggaaatggcctgcgtgatggcagcagtgggtcattctggtgtatatagcggaattgtatcgggaatagacggagctaaaataacatttggcccgattgccggtttatccacaaaaagaaagctcggttatataaaaacatattatgatgtccctgaaatagtaatccccactatttaggacttcttggaaaacatc

SEQ ID NO: 442 - DNA, 994 bp, Unknown
  derived from dsRNAs of unknown virus
gaataaattctatctatgtcttcatatacatcgaaaatgagtgcaatgaactttgcggacgacggtgcacatatgattgcggaggctgatatccttaagggcagctttggtccacaagtcgatcaatatttggggcaaagccctattgatgggccaccaggctataccttccaaaaggtatattactctgcacaaggcgttgcgcaaacagatagcgccaccgtgacccaactgaccgctatctaccagaaggctccagcacacacaggactgctattgaatagcaatgggacaacctcgagcatcggtgcgaatgatatgagcctcacgctgattaatcaggatcaagctggaggatcgggcatatcgaattcaaacaggcttgaaagtggagattttatattgggcgcattgttgcgtgccatagatacaaagcccgatgatacacgtcaaggtaatttcacggctggctacgccgcggtggggaaactcaccagaggctcatcgccctttccccccattctcgcctcgaaccatatcgtattcgaaacgtttggtgtaccagctgatcatgcgacaaaggttcatcaacgaagcaatgctatcagcaatgagctcggcatcagccatgctagcacagccgtctcgtgcacaaatgggttagagtttcataacatgacccaggcaatgggactgacaggaaaagatagtgtaagtggagcttctgcagccgacaagaacctcgtggacactaaagcgccagtgttagcaatcgtggcggatgggattgctggagcggatcaaataaaagtatcgctttgtgtttacgcacttgtagcaccccgtgttgatacaggggaagcgatacaagtacctaaccgcaatttcaaactgcatgatgtcgccgcaaagtgtaaacctcaatatcttagttatgtggcatagtgctcaccgtaagtcaaaacggggctcttgagcaggaatcgaaaacatc

SEQ ID NO: 443 - DNA, 2311 bp, Unknown
  derived from dsRNAs of unknown virus
gaatgattgagccactcataatctcaagataacaacaagttataagatgtcaaccacagtttcacctatcgccgaagttgcgaacctcccgccggttagcgggatcgaagtagaacgtgcattagcattaatatcttatggttggatatcgggtgtcgatccgttgcaagaattgctccaaatggatcgatctggtatgccggttgaagaaactggtagtctgagaagatttgtgaagaaggtgaataccatcgtaaggggcggtggtgcatcttcaccacttatcaatgagctaggcgatcgtgaagtccttgcttcctaccctctcgacgacctcatcggcgcgtcaacggtaggggacgggccctttaatgcacgtttaccctttttgaggtcacaagcgttgcaggaccgtcagatgggcaaacttcgcgacaatctacctcgactggaacctccaccagccggtggtagcttcagatacctaacgtatcgaagccttccaagtgccatgatcccatcaatcgtggaaccaaagatttccgagggaaatggagaatccgcatttactgtgcacgtgggcacaccgttcgtatctactacacgtactctgtctgtctctaacacggaaggtgaggtcaatgatctcctgcactccaaatcagaatacgtggcgtcacgctataatgtgtctgaggtaaaaggagaggggaagacgatcaaagtgaacctgaagggccgggtactaaaagagatgttcacgaaaggagtacacttcgaagttcaaatgagcaagatggaatttccattaagccaagacgcttgctttgcggcgctcacaaagagaggcggtgtacaatgcgtgatatcaagtggtattaaattcggtgataaaacgatactcaattgtgtgttcgaatataccactcaagagatggcaagagacccaaataatggatcgccagttagttttggggtagattatcgtctgatactacgtttgacgttcgagaatctaactcacactgacatttcaaatttggacggtgcgcttcagccctcaggcgcgttcttcatcacagcgatgcagctgaactcatatgctggaaaactcaccccaactggacaaccttggttacctcatgatgtattaactgcatctgataaccctgacgaaattcagtctctgctctcgatagccagagtttcgatgcatggtcaagagcgtgaaacggacctttccatacgcgcgtccctcgttgacagctggaccatgctaccactcaccctgaaggatcatcctgacctactccagggctcatctgcttatcgccccagggttgcgataacgaagatgggcctagaactagaagatattgaaaatatgtacgatactcagtctccacaaatggatgcactccatgccaatctgttcggtcgaatgctagccgtattcgctggcgaggacattaggaagggaattgaagatgaccgactcaacgactattataatagtgctttacagtacgttactgataatagcgggccggccattacccattctggaatagttcggactacaacgccagaggatggcggaacatttactaaagcgaaggtaatacttgctcggttgatgctgtcacgacttgttacgacgggaatacgattcagaggtgaaagtagtcgagatgcgttctccccgttccacatgtggagcccccaggacatgcactcgtttaagatcccatattgtgtttctagtcgtgggatttttgtatacagctgtgatgatctgttcgtgcgactactgtcagccggggaacgatgggaagataagaatgtaacgacttaccgaagtccaagagcgacggtagcgggcgagatattcgctcccctgtacaaacgtacagataaatcaacacattctgtggtgttgccaaacggaaaagaagtctgttgcgatggcattattcacgatatggcagcgctctttttgcgcgttcctgagcagaaccgccccgccacgagattcgtggtatggcatcccgcgttctgcataatcatgaagacccctacgaagtttggagctcaccaaggtctgaacgctaccgtaattgacggacctagagccagccgaatcgtgagaccatacaaaaacaccttagaagtaaaacagcgcgtacgcaattttgacctatcagtacatgaagcgatggtaataagtgcggcgggttataccgaagcactgctaaacttcttgtcagtagaataaaaagagattatgagacccgccggccacgaaaccatc

SEQ ID NO: 444 - DNA, 1737 bp, Unknown
  derived from dsRNAs of unknown virus
gaatattatgtattagtgaaatagagagttaagatagcattaaatcatgagtaacagagaaatgagagggctaacagtgaccggaggtgtcaacacctccaatctgatgtcactgacaacaggcacggtgtcttctccgcaagtaatatccggcgtaaccgaattcacgaacacgaatggtgtgaccatggccaaattgaaagttactgacattgatgcaagcaaaattctagccactaatgcggataaggagataatagctgcgacaaacgtaccactactgaacagcaataacacattcaccggaaacttagatgtaggaggtgatacaagtgtattaacattcgattcaagtggtgtgacccaactggcgactggtcgtggagctaccactgtaggaggtacgctaaccgttaatggggcagaatctgcgaccactggtgtaaccatcgctgctggaaagacgttaacagttggaaatggctccacaaccctaggaggcactttggacgtaaccggcgacacaagcgtaacttcattggattcaagtggaataactcaactggcgactcaaggtggagctactagcgtgggaggcacgttggatgtaactggtgatacaagtgtaagcacatttgattccagtggtgtaactcaagtagcgactggccgtggagctaccaccgtaggaggcacgctaaccattaatggggcagagtccacagctgatggcgtgaccatcgccgctgggaagaagctgactgttggaagcggcgccacgacactgggtggtactctggacgtcaccggcgatacaagtgtaacttcactggattccagtggaatcacacagctggcaacaggtggtggagctactagtgtgggaggtgctttgaatgcgactggcacagttttcaccccacagataaacttgggttcgaacataacttatggtggcagtgcagcaccgttccagatggctaagccgactggacgtagcatgaacatggtaatgaccacaggtcttcaagataacctatttttgcaaactgcatactttgcaggtaacacatctaatgagagacttatgattgacacctacgtctatttttccaacaacggcatgaagtatactattcataagaataataccaacgggggtcttcgcgaagatttcaggattgaagcgggtgggcagacgttgactcgtggcgcagtcggcaatctaagtgacgaccgttataaggtgaacgaagagccattgtcatcgtgtctagatacgattcgtaaacttaagccaaccaaatactaccttacagatgacaagttcgatgcagattgtgtgtttgaaactaactcagacgacataccaataagagcagatggcaacatcatacgtggcagctggcaagatggtttcatcgcacaggaggtactagagatatcagaactaaaacatctagtcaatgatcaacgagagaatgaatcttttgacgatggtgaagggtcgactattagtaacatggaaataactatcatgtacgatggcatatttgttagatcagtacaagcgttacaagaactggatagaaaagtatcccagcttgaggcacgtatattaacattagagaatcgtgatggctcataaactaaataacatgtatacaacatgataatgctcaagactctcgcacacctgacgcccatcagtttcattttaatacgtatgaagacatc

SEQ ID NO: 445 - DNA, 1367 bp, Unknown
  derived from dsRNAs of unknown virus
gaagtcgataacagctatttaaacattcagatattgcgtcatggcaaacatattaagtggagatgcatctattactgacagattgcgtgactcagttggtttcaaaattaaagggtttggagatgacctgataatcaagagaattcgagcacatacaacggctgtatccgggtccggtacgtcagctttggcgtccgtaacactcggtggaactttaatcgctggaactgcaacatcgggcgtgtacgtaggagcttccgatttttcggataagcaaacaattgcacctctattagctacgtcacgtggtgcgcgagtagcgcgtgatgatttcttcttgggtggaatcttaagattgttagatggaagggcgcctgatgtgcgctcaggttttgtaactggcggtttggcatatgatcagccagtgaagctgctgaccacagataacaattttaaaacaaatactccagttgcgctttcgccaattttgagcgatacatcagggaacttgaaatcaaaagaatggcacagtgggagcgtaaccacggctgcagcgggacgagatgtcacggaagtgcatatcaatgagttgtcctacgtaccgcgcatgtgcggtggaaacggtaggtactcttcgaccgtagttaatatcacatcaactgatattttacaggcgaaggaatcacttgctcaaacacctgtcttatttcatgattttaatggaagcgttaatatgtacggtgagagtccgtacattgcatgcgacgtacatttttcaggggcctccgatggaaattttccgaatggcagagagttccggctgatggcaattggggtaggaggtgaagtagaaattgttgatactgcgtattccacggttacaaccgggtttgatagcgttaggctatcaggggtaccttctcttagcctcggtcctatatgcaccgtagtcgtgaattctctttccgctgtgactaggcaaagcgcgcgtattatggtaacgtgtgacagctcaatgtttcgaatcccgcgacgtcacatcatcctagatggatatactgatcaaaagccagtcactttcgaaattgaggatttctatctaggatgggacgagggtacatcaaacttacctaagaataacggggaagtaacgctagaatatcttcttacggggaaggaacctcccccggtacggaaggtagagcaaccacgacccatagagagtgcgcagtattacgattagtcgcagcggatagtctttgtatagatatactgctaagtatgtatatgaccattttcaaaatgatttttatagcccacaattatcccatggtaacgggaagctcataagcgtgatcgaaatagtc

SEQ ID NO: 446 - DNA, 1279 bp, Unknown
  derived from dsRNAs of unknown virus
aatttaaagaattctcaatgttcggcaaccaaaacgactcgtccaagggactgtagaacgggatgggcggttcaatctccgtgaactaaaaccagattgactccggtaaccagcagcaaattgatgctctgcgagccagcgtcgaattggaatgattgtcaaagaacttcaccgacgaaatcaacctcatgaaggaaaatctagcgcgccaacacggtcagcaagctatgcgaggaatcactactttgaagaaaccagtcgtcaaaaacgcaaaggagatgatgtttatcaatctaatgagtagacttctcgaacgaacgaccaatcgagctagaagcaagcaatgggaagaaacggcccgcatggaagacaccaccaaaacttgtacttagttactcgagtgctacacaaaaatgagaacccacacatgcgtgatgaggatcgaagccgaggaacaagttatcaagatgaacaagatgaaagacaggatcgaggccgtcaccatcaacatggcaaaagagaaggagagagcactggaataactccagattcagagtcaccaagcactagcctccatcaacaacctcaaccaagccattcttggaaagcaagtccagcagattcagcaaatgaactggcaatccaaaccacaactccaaattcagcaacaaccggatcaacgacaagattagcaacaaccggtagaacaagcatcaccagccatcgagggcaacaaccaacttgttcctttctacaatccttccgacgagcagaaacttacaatggaactgtaagcgagcatcaatcagcagcaacactttaacaaagagagagttatgattgagtcaaggattcaagcacttaagaagcatgtcccaactctcgagctgagacctatagtgcagaacatcgctgaggagatcagaattgaagtgaatgactctcacaccaggcagacaggatacgtggtctacagacccaatgaaatactgcagtcaaggcctgaatgagattggaaccgcttaggtggtactgcttctatcaacactggctataaggattttgtcaaaagatatatataacaagggcgggttagattctagactagttctgaaggtcactcaaggcgctgggcgtttaatgctacgagactacagacctcctgttaggagagaaagaagacgagtgtgtgagactaatgcaagctgtgtgatttatttgttagttaaataataaatgtagttaagttaatttagagacagaacttacaactggctcc

SEQ ID NO: 447 - DNA, 960 bp, Unknown
  derived from dsRNAs of unknown virus
gaatattacttgatcaatagatactgtcaaataaatgggtcgtaaccttgttaagcgtacgatatcagatggcgctacgtcaactcgaccacgagataaacctgctgtgataagtactaaggggggtacaccactaccaaagccacgtctacaaacatacgtcgtgtatgatgagccaaaagctgcagtagatgacatgccaacaccttatgttgaaccacacacagcagtacgtaagcctgtaatttcaagaactctcgacgacatcagtgattttaatcaaaaagctggtgagggggtaaaaacgggattaggtgaaatatcagatggattcgacaaatttgcgaacttattccgcgcttcgagcgaggctaggaagagccatatggaacctgcgcacgatgcagtcttacgttttctagcacttacaaaatttgagaatgagcgcaagcgcatacgtgctctacctgatatcacaatcgtggagatagataggtattttaccgttctgtttgacccgggaagtggtatcacgtacgttgagtggcgtccaacagaagatattaaaaatatatcatcaaatttcaaaaacgtaggtagagaatggagcgaagacttcttagctgcattcggaatgaacattccagcgtggaccaagagagtgaaatacataaaagataaatatggaatggaaagcgaaaaagtgagacattatggctactcgcgtggtggcggtctagctacgcacatgggaggtactggatatggaacgggatatttctcgtcatatctgcctgacaaaaggtcgaagtcaaaatttagtggtgacccgctacatgattacctaattaatccattatcttattcactaatgtttcgtaacatactcaaaggacgatgaatttattgaactgtgcattctagctgcaccgagctaatgatgcaagtatgaagtacatc

SEQ ID NO: 448 - DNA, 1981 bp, Unknown
  derived from dsRNAs of unknown virus
tagaaaagtacatatactttgaaggatatcccatcattcttccatgtggaacccccgtggttgaccctaaataaaattttcttccctcttttattgatgaaaggtcatcttaattccatcactaacggtgaatatggtttacaaaaccataatatatttaacgaccttgagtcatgatttgaatatcttcgagcctccggctttttaattgatcttaacaacaacgaattttatgattcggatgtgtttaaaaaacttgaaattcgttacaaccgcatcatttctacattatcattgggcacatatactccaggagtaagtaactcatatgagaactgtcgtcgtattgttgtggctgcacttatttttagaaagcacttaattaaccaatattattttgatgttgctaatccgtctctacttcgttctgttttacgtaacgataagctttataacaatgttatccatcgttctcgcactttaaaattaaatatccattataaattaattaaatttgcaaaagatcatgctaacaaacatcttcttaaagtttgaccctctatcaaacatattattgatatgaatcctgattctgaatttgtttctaatgttaaaaaagctgagcaaaaccttaatgatgctgcgaaactacagttacccctaaatcttgaccctcatttaattgatgagttagcaaaaactttatgtatctttctttctaaccactttggtgataaaattattcatgcaaagttcccaactttaaaagatctttttattcgttcaaagatggatgctcaatctggttttcccggtcttaacggtcgtcttgttataaaacgcaaagtatttatccagtgtattgtattattacttagtttattagaaaattgtgataaggcaactcgtgtgtacaacaattatttttctaaacaacctagtcatgttcttactcgtaaacagactaagtggtctgattcaaaacgaattactaatgtaaagttacgtttagtttttaatgttcctgcacaagtaattatcgttcacttatttttatggttaataatttatcctattattaaggcaaatagccatattataagtactggtataatgcaagttgaaattagtaaacgtatcgaaagtttaaagaattttaatactttttgagttgatgctaaagacttcgaccattatttttctaatgtatttagtttagtaattatgttttcttggcaccgaattttcttttctgaatgtcttattattaaaagaatcagtcttagaatgattcgtactgtccttcttattccatattgacataaatgcctcggaaaccgtattgccagtcgtgttactggtgtgtcttcaggtgacgtctttacaagtttattaggtagtagcgtaactagttttaattttatttttgtaacgcgtaagatgggtattgaatttcattacacacgacattttgtattaggagatgacctaacgtttggaactcttagttgtgttgtttttgatattgatttattcataaagttatcaaaagattttggttgtatacattattcatatactcgtaatgaatatggcgttattaatgaatttgctcgggttggtgttgatcgcgccttcttcttaggttctctttgagtaaacgggcgtccatgacgtaacatacaagcaatcattgctcaaatcattattccaatgtattctactggtccaaaagttagaatgtccaattttcttttagctcgtataatagagattggtggtaattcttctaattgcaaagatcttctcattggatttggttataaaattgatagaattgttggcaaaacagtaagtatacgagttattacccctggacatgatggtactttccgtccgtcacgtatatcctatgtcattccaaaagatgtgaataacatatggcgtagtcgttaatcagactactgggacttactgccca

SEQ ID NO: 449 - DNA, 906 bp, Unknown
  derived from dsRNAs of unknown virus
gaatattcttgctaatacctatcttttcgtatgtcgagtccgaggcggagatccgatctcacacccccgcaatttgcaattcagtggactgcagctgaagttgtacttgaacgtgttaaacattcatgctatacgtttcatttacaatatagacgcagatacttattggccagaacaagattagcatactatgatatacccattattgttctttcaagcgtgaatagtgtattcatcgctggcggtaatacattcatgaacgcagaagcggtatatttaataacatgtatgctggcccttggcgtaggtataattcaagctgttaagacgtttctaaaagtagatgaaaatcgtgaaaattgtctagttacatacaaagacttatttcgtttgttctgtgaactctccatcatgttagaccagccacgtgagacccgaggtgtggacccacaaaagtggatggctgacaaaaacagtgaatataaggagattatgaacaaagcgattgtacttgaagacagacgtttaaggaacaatcctatttacgatgatttacatccggcaaagaaaagtgctgatgatgattcaacaccacggcacatcagtgctatgagtgaaacgcatcatcactttccgatggatgcacttgatgtccatgatattgactttcgtgagtcggcgcagactactgcagctggcggagacgcgtttgctaagcaagcaaaacttcacgagataaccgagcgtctaggcgtggataaacttatttcactggatgcggatgctgagatgaggccacccgtttcattgagcgataacgacgattgacatggcgttgtcaattgaggtaggttgatgtatatcacttgtgatatgcgccttagtgttagcaggatgagatacatc

SEQ ID NO: 450 - DNA, 1362 bp, Unknown; identical to SEQ ID NO: 351
  derived from dsRNAs of unknown virus

SEQ ID NO: 451 - DNA, 549 bp, Unknown
  derived from dsRNAs of unknown virus
gaataaattttacatttagttatgggcataaaaggtggatctcgtaaatctcgcagacactccaaggagcagcgcaaggaaaaacggctagtgcataaaaacgatgtgaagttgaggaaggagtgttcaaaacttcctgacgatatgatcttcacaatattaacgtttattgatacgacagaaagccgtgcacaatgcgctgacaaacctaagggtatgcactactacatcaacgatttcacttcaacgatgaatgcaatatgggagcttcggcaatataccctaatgagccaacatctatcattctggcggaagtatattccaacaggagtgatatcgcgtaggcatgtgtttcgaccgacaatcccttcatggtgttattatgaaaccgaggggtttcgcaatttgccatatcgaacaagattcaggataatgcgcctagcggcgatgaaagctacacaagcgcagtcacaacttgactccaccagcccataactaatgctcccattctagccgggagtagtttcgacatgtgaaatcgaagacatc

SEQ ID NO: 452 - DNA, 1746 bp, Unknown
  derived from dsRNAs of unknown virus
gttttaaaattacacttattcataacgaatataaaaatttactaaaatttatcatataaaatatggattttattaaaagactttcgcaagctgacatttcttcaatcttcagcaaggaaggggaagttaacgcttccggagccttcacccgattacgcttaggccagggtccaactccacgtactcctctgtacaaaaacattcctcaagacattgttcttcaaatgtgggttgacatccttaaccgtatgaaggatgattctaattttgggcccgaagattcaggctacataggagacctgatcacatatgacttatcccgctccgagaaatttggtccacagggagaattaagaccattcgcagaaagagctgaggatttagcgggttactaccaaaataatcatttccacggatttgatttaattgacgaggaatgtatagagaaggtcgcccttactatttttggtaatagtctaaatcaattaagacctctctccctgaataatgtcattaaacgagatcagtacgatgacaaattaaatacaaattcaggatgcccagatttcacaaaacgtagcaacccccttgttacacataacgcgattcgggatgctgaaactggaaggtggagacattatccaatggcgttaggctctagatcacagagaggaagtgagcggttcatcttcatggctccgtattcaatgaatcttaaggagaaaacgtacctatatccgatgttggatatggttaataaattaggtgtgttagaattgtcagcatggcggggcttccctgaagtagaactaggtttcgctaagatgggattctttcgagaagacaaggcttatatgcaaattgattacactaaaatggataaatactacaattttacctgcaattctattgtcacgaaagtcgtcgaaaagggctttcaaccaagatatcgtgaagacattgcagaagtacttaaccattatatggaagtacctatcctaatacaaattgataaaatgatcgcagatccaaaaggccatggtatgcctagcggttctggatttaccaacttcagtgagacgttggtgtctttgtatctatattatcttcttcaaaaactagacccgagttatggtattgaaaattgccaatgcctaggagatgatatggtaatctcattcgacagagagatcctcagcaatcgcgaggagggatttgaaacaatcgctaagtatattggagacactgcgaagcaaaatttaggactacaaatgtccgcagaaaagcagcgagtcgactccattactacagtttacctacaacgtttcttcgacgagaggattcgcgacgcagaaggagtagttgtaggatgttaccccagtattttagcgctaaatactgcagtaaaccccgagaggtaccatgatcctcgaaaatggagtaaagaaatggagatacttcgatggctaatgattctcgagaattgtaacaagcttccttacttttccgaactagtcaaattctttattaagggtgataagtataaattaggattacttattccaggtttcttcgattcgttaaccgtaatctacgaagaaggtaaagctataaagggttttgtgccaagttataacaatgatttcaatgatcgtgggatcatggatttctatgttgttaaatacttgatacaaaatcgctcggcgcttgaaaacgagtaacgcttgggtggagtctctccacctc

SEQ ID NO: 453 - DNA, 2558 bp, Unknown
  derived from dsRNAs of unknown virus
gaagaacaacgtgacgattacactgagtctaggacgagcttttccatgggagacgcacataaaggcagttcgaacaggtcaggctaccttcctccttcatatggtggacgttacactggcgttgaagatgttgtatcgacaacgcgcagtcagatgctccacgatttgcttgagaggatgcggtcgcctgcccatcgcacgcttcccccgcttggtgacttttcgatgctaacaaagactgtactcaatttgggtcaggctatgccgcggactgtggagacaaatgctcaagaagttctactcaattctcgtatcctgcacgagctcgcatgctccatgaagtgtattcacggagcagtcgaccaactgcttgcgacgtcagaggttcatcatgtaggcatgaagacggatcaccgtcagcgggccttcaaaacgcttctactcccaagcggtgatgatgcaaacggtcttaccccagttgaggcccagtcaaatgcggcgatccggaagtactcctcaacgattacattccagaccacccttgactcgacgcaaatcacggttttcttgccagcgatctacgagcgcaacgcagacaacggctgcttcttgtacatcaagctcttcactgagacacctttcggcctgtctctcgttgacgaccgtacgacgataatcatcccaacgactgaggcgtcatggggccacttctcaagtggcttcgagttcgccaatacgtcagcgactgatgacactcgtggtacagtcagtgcaacggcagcctcaccatccacaaaggggttcgcaggcatcagaggagccgatcttgtcaagataacagaaaccgtcagagacaggggcgttcgagcgcaaccacagaatcgtgtgctgtttgtccgaaacgactgttcgactcgttacatgaccataaggaataggtcatcgccatcgatggctccattccttcaaacgactgtagcaactcagaacctgttggcttcgggcgacgaaacattcaccgacacgatcgagtcaaggcgtctggctccgattcagattttcgactctcagggttgtggcgctacagctgtttcaccgtacttcagtcgatctcagcatgacaggaccgctctggctttcattgaaatctctggttccggaaccgggtacactacaccaccaactatcacgatccctgatcctggtaagtatggtgtacaagccaccgctgtagctaccatcgttggtggtgtgctcactgaggtgacaataaccgaacatggtcatggctatacatcagcacccacaatttcggttacgggtggtggtgctcccacggctgtgtcgacgatggtcgcgcatctcgtcggttctgcatccggacaagggtccctagctggacgtgctgtacccaacttctcaatgcccgctgagggcgttggttcgtggtcggctaacaacgtctcaacggctgagccttcagctggttggaagggtaactcgcccctcgcgggtttccctaaaccagctgatcatgctggagcgttgactgtccgtcgcttggcctcgctgcaacctgttggcagggacgacgcgccgctacttgttggcgctcgtttccgcgtcaaaggtacaattaccaagacatggcacgacgtcgatgacacggatgacaacgttatgcaattcctttatttgtttgctaccgcgcaatccgataatggagttacatacggctttcataccgggccagacaccggtcccgggcagattggaattcccgagccgtttgctggagttggagatagggcgccaaccgcgaagccagccgggttcacaccttacggtgaggactttggcgatgccagaccgatgaactacgccattattgatttgaactccgtaggccgtctgtacggcgaaggtacggttgttccaatcgatgcgaccattatcatcgacaacactcttggagctgacggaagtggtttctggccggtagcctatggtacctctgacggcaccgccgatggcggtacgtcagcgaggactggactgcccgctttgaacacccttgacgacgcgatccttgatcgcgatggctggtcgcgctggaaccgttcttcagcacgtcaattctcgccctacaagcccttcaacctcgaacgatcaaacttgtacgctatggttctcactggcaaccttgcaaacggagaaaccgaacaagcaatgtcaacgtgggacctttcgaacattaccgttgaggttgaatcgcttcgatcagccacggaagcaggcgaccgtatcgcaattgcctgtgcatcaaaccaaggacaagcacagtatggcatcaaagttgatgtcaatactgtttctcgaccaaaagactcagaaaccgtcgcctttccaattgttggcgatccggttgtgactgatgacctctgtaaaaccctttccgttcttccgaacgcgcatatgggatcaaaggttgacatgtcaaggtgatctgaaaaacgggctctttgtggagagactgttcctcccgtgttgtaactatc

SEQ ID NO: 454 - DNA, 3949 bp, Unknown
  derived from dsRNAs of unknown virus
gaagaattcgctatgctagacccaggattaatcccccagggtggtgaagtaatcgtaccggaacaggcacaggtgagcgagtctctcgcgcgagccgtgcaaaccgtttcaagtgcgtgcgccgcttcgttcgcaccaccgcagggttcgtcgggaagtgggcgattcgcgcatctcaggcatatcgatggactgcgcttcggcgcggtcctcggtcagcctagagagcgagaacgggtcgtaatcggttccaaggtcattgcaaattccagagatgcattacgtacttacttacgtacggttggcgtcggtgtcgcggtaacaagtggatgtctgaatacctctgacgcgagactcgcatggggtggaattcgtccatttgaagcggcgaggttgctacaactcgttgagaagcagctgacacccggcgcaaccggagtgagtcttgagagtgatgaggctcattactttgacgctcaaggcgacggtgacgacgacgacgccgcaccgccagagcggacactggtcaacatcggtctggacatcggtcgtatgcaacgaattccagattggctcctcgctcgtgttgagtattcgccattcagggtcgttgacaactacgagatcttcgagatcagccttggtgtgtccaacgctcggattggtggtttgtacgcaacgtcgctaccttctcgaggagtcaccggttcaatccaaggacagatggctgttgaggcaatcactcaaaaacttgaaccgggtgttaacatcacgccccgtggtcacatcatgattgatgtcgatgcggaaatggccttccttgaagagctcctcaagatcattcggtggaacaccactgaaaaaggactgactccgccacacgcaaaggccctcttccaggcgtacgcctacgtcatgactctcaatactgaattgcccaagtttgacactgcgcatgtgatgttagcgagttacatcaaggcgtccgagatttgcatcaacggtttgctcgataaggagcaaggtgttcacgtaccggacgcggcgcgcaggcttcatgctcacgctcccgctgtctggtgctatgtcttctttgccgcaaacctcttgcgctggaccgtcatcaagggcggaagtggagtgccacgtgaagacggaccgtttgtgcgcaaacagggtgagttgagtttccgagcagtctacgagtgcttccttccggaatgtgtttccaccgttacacacgagagtgcagacggtgaaaagacgtacggatggaaggaagcgacgaattggtatgacatcgtgtgtcgtacgtcgcatcgtactgcactgcgttcggacatcatcaacttgtcgtggttcgaccatcagaatcttctgatgggtgctactggtgccatcacgacgacgacgtcgtaccagcgggagaagttcaaggcattgacgattgtgttgtcaaatgacatcccagtcggaccagcaaaggacaaaatcagtacgtacatcgctttgaaaggtcacatgaagtccaagctcgaagagcaaagacttcaagagcctgtcactaagatgttaaacatgttcttctgttcggacaagttcggtgaagtcaaagccacgcccgatggaacctttgtgcagttcagagaagggatgttcacgacaggtgacgagtacgactcctttgagtccggattcgtcaagatatcgtacatttcactctcgaacggcatctacggacaggcgaacgcacggatcaagctcgtgtgcacgctaactgagacagcgctcgaacagctcccattcattcagaagggagtaggcgatgatggtgaaccagctctcgaatacgtcaaagatctcgaacgcgggctcgaacagcactacggtgctaactcggcgaccgctcgactcaaaggcggatcgatcgttgtgatcctcgcgttcgaaaacggttatctcacaccaaattggaccagaggaggacgtcgcgatcgcgacggccttgaacaatgtcttctgacggtggccgacggttctccaacgagctcagtcttgcggaaaggtttgactgaacgcgctgaatcagtgaaagtcaggaactacgacgtggcctacgatgaggagggtgccccaagcaccgtgactcgaaggagttcggccgtcgatcctgctcctgaacatgcgcatggagtcaccgtgatcggaaacatcgtgactgacccagccttgagcattcttcagtcaatggtgcagacggtaccagctggtaacatcttgaacatgtaccagttgtacctcgactcggctgatcgcacgacgttctccgattttctcgctacggacccgcactcagtgcagtatctgcaaacattgcctacggcagtggtggcgatgctgaaagtggttcttccagtcacgcacacagacacaggtctgtgcaacgtgatctatcgtggtatgcctcacccaccgaagatcatcttcaatcggaacttcgtcaaactcgatgtcgacgcagttcttgagggtgctaacggtgagtctattgacctcgctcttcttggactccagcgtccaggagcgaggccgacagctgacccgtataaacacctctcctcgctgcgtgttgaaacttgtaccgccacatccggactcactatgcgtctggttgtcggtttcatcgaataccttgccacccaagggagtactggagatgagctaatcaaagacctcgtcgaggtcggttaccatctctggtgggaaagagctgttttccgctcaaccgaggatccaggtctttttgacctgatcgacaatcgagccatggatgaagacttcgctaaaaactatctgcgtagcttctgggactcaatgttcacacaggttatctcacgtgagggttatgagagacgtacgtactctcatcacaatcatgatgcgatttttgtcagacttgtgttatcgacgttcctgacgctccagacagctgaagtgtcgctttcaactggcttgactgttcgagacatcatcgatcaagagcgcagcacaactggtccatcccctgatcatgcgatcgtgttaccatctcggcgtaacggacgtgcgatcatctgtcagccaagtattgtaccctcaaaacttggaggtattggcagattgaagatccgcatcgcagctccgcacaacatccaagtcgtcatgctacagccacgcgacaggaaaaatgtggaaagcacgttcgaacaccattttcggcacgtacagccattaacgtcacaaggtcagatgcgcaatccgatacagaggcagaggacaaccgttaatgccataacgcaaattaggcagcaacggacgtctaaggtcctctacaccgttagtcggtcatcgggcatggaggttggttcaatccaaacaccttctattgcaacaacatcgattggcgacgtcaccccatctgaccaagaagggtttcccgacatcctagccggcgttgattgcaacgccgggcttggatccgagagatgcatcaaaatcaacgagggcggtgaacttgtcaatggaattgatacgatcgtgcaaaaggtgcgccttttcgccgcttgtcatgagatgatgaacgctaaacatcgaggtcaactttatgtcgtaaacacggctatggtgtatgtttttgttggatgcagatggttgtacaaagacgatccatcacaagacatcctcctcgagacgtacgcctatgttgattccgatgtgcgcttctcatcacgattggcgcgaggaagaggcgtgctgcacgacttgcgcatgcacgggatgactaggagtgttgccgaaaagatcgatgagtctcgcaaaggtaagcgagaactgctcgctcccgaaaaattggatatccctacgttctagcattccgtaagctctgtcggttaaagtgaattgaactatc

SEQ ID NO: 455 - DNA, 1522 bp, Unknown
  derived from dsRNAs of unknown virus
gaatagaaatcccttcccacgataaataacatggaaattattgatttgagggttatcgaacgtgccaagagagatggtttcagagccgcatcagccggatacctaatcaagctaatcacacaagctttaggagttaaaactgacgatatcgaagacgatgaacgtcttgaatcgttatcaaaacgaatgggcgtaacaagacgcgttctagtagaggaactaaagaaaatcaatgaagctatgaaagatagagtttccccaggcgaggtttatgattttaaggagctacgcagacataaagggcggatcgacctgcaatcactactatgtaacggattatataacgaggtggaagtatatcattatgaaaactatttaagttacataatgccacctaattctgacaggatagtatatacaacagacattccaatcacagtcagcggcgacgtttttacgattaactcacagcacaatgggcgctaccacattcattatgcatctaaagtgagtgatataaaaagaatgtttaactacacaaaatttaggctacattcaggaagtcaaactgtcgtaatagatggtattggcgtcgaatcgattgataatggcatgatgactttagcactaaacatcgacatgtcacaacatgacaaattctcagacgtgcataacttattaatgtcagcgaactatgtaacgtattcatatgataaagttgcaccatttataatcgagcgcgctggattagaccagggaactttgataatgcatgtattccctcaatctgatggaacagcgcttaccaactggatgcagcattgtgaaacttcactagaacgaatgcttatatcaatactaaatacactgaaaaccaagggtgaggcatactcaagcaaaggcttaggtggtcaatttcccatcgatttctatggtgtgttgagaggaactttggatgctctggatccagcaaaaagttcaaattctaatacgtcacgtcgaattccagataaaatagtgatagatgagttattcaaaggatatatcaatggcgtgagaaccggtgtagtatcagaaagaataagaatcgccttcgggtgtttaaaaacaagaaataagccacacaatctaattaacttacaactattcattaaatcctatctatcctttgctggtctcttccaatattatgatgatataatgacattcaataaggacgtagacggagtgaaagatgtcacaaagcagtctcgtgtaactgagcaattattatctttcatagataaaggtagtatgatgctgaaagagctcgagcaaaaggcaggcattatcgtcgataagttaccaaactccgccgatgagtacattgatcatataattaatcaggttactaaaataatctccccagttcaaagatacctcaattaatattaccatgttgttacggatgatgaaaagttggtgacgcttccctaaactcatacctatagtggggccggccgcggcaaaggatggtaacatc

SEQ ID NO: 456 - DNA, 886 bp, Unknown; identical to SEQ ID NO: 414
  derived from dsRNAs of unknown virus

SEQ ID NO: 457 - DNA, 1406 bp, Unknown; identical to SEQ ID NO: 332
  derived from dsRNAs of unknown virus

SEQ ID NO: 458 - DNA, 1433 bp, Unknown
  derived from dsRNAs of unknown virus
ggtttaaaaagattaggctcacttcatggctggtagagttcgcgattatgtcgatttagataccttttgtttgactgacggaaattgtatgtcatcttcttatattgtcgcagaagctgcagatagagctgattttccgcagggtttgactgaccaacaacggttgaatttattcaccgcagtattgctaattccaattgttacaggcgtcgggtcaattgtacgaggaccaattcacttgtgggaacgtgcattgtcggatttagagccagacgatctagtggtcgatcgcctggtggggatacttgatgggcgtggtaacccaggtgaacacgtgaatactgttttaccaaattttgatgaacacaggaggagtggatatttgaatgatgttctcgagggaatctcccgttaccgctaaagttatgggatgccgatgttccgtgccccaaaaacaacctggtatgcgatttcagactccggtgactgaaaatgatctgaatgatggactgcgaaaagctggatatgatggagatccgctaacggctgagaataaacgactattaactgaatttggatatgattttagcgagaccagtgatcatcgagacaaccaagatgtattccgtagtatggatactatgaaatatgatgtggtgcaactcgctcaacgtgctgaccatcattggtgggatccagtagacgatggtacgccacacagtggcaaccggtgtctgtacagcgatgtgaggtgctatagtggatacccaggaatgtctgaacaatatagtgttacacgcatcgatgatgcaatgcgtgagaggtatgtagactgggataaaggagggtatagcatccattttcgaacaacgcgtagtcacaaatggcacgttttaatgatgtttaattttctcgaatcgagggtacctctagaagttagacgttgggacatcactaaacatgataattcgaaattctcagttgacgaagttcaagggtatgttgaccgatgggtgtggggaacgcaatctgataaatgggaattagcagtgaagcatcactacgctaacaatgaccatcatcatgaatattgggttgacgctgatggtgtagctactaggatgccagaacgagcagtggaacatgccatcatcgataaattggcagttggatgggaacgtgtgttttcgtcaaaacctacgttaattgaagacttagtggccaatgcgagaaagtttccgatacgtggacattctgaatccgttgaatattttaaccagaaactagacgagatcgcggcattaaataccagtgtgcatgttgtcaagctgtcgtgcaaatgcctacagtaccatacggacccttgtgacctacatgagtagtcacgcctgggtctgagctctatggtgtaggtgccaaacatctttccgacc

SEQ ID NO: 459 - DNA, 4228 bp, Unknown
  derived from dsRNAs of unknown virus
gaatattttaaactacataatgcagaacataattgagttacagaatgaacgagaacgtagtatcagagatcgacttcataccattaaagatcttgtgctggagacacaacgcgttgtgcgcccaggacaagataaagcgatggttgatgttggcaactcacaatttgacatgatgtcaaaggtggggacatacttcatgcaagtattgaaagatcacccagaagaaggtgaacgagcaatgttaatgattgaagagtggtcaaaacaagatcgcgcatcagaaaacgcaaacgttacaaagaacgacttcttcccatgcgtaattagatcaattaaggaaaaggaatttgacattttgcaacctccagctgtgctaacacaacatggcatggataaaatgttaagagctggtgtcggtggagagtacggagtaacgaaagaagatttcgagacctcattcttgcataacgtatccaagaacgaggtaacgatagtagaaaaaggatcctcgtgcgtagtaaatggtgtatcattgaagctaacaccaattgaagcaagatcaacggataagaaaccgccaattgacagtgacgtatcatatactgagtcatggattaataggtggggtgaggcgcgccgttacacacctttcacattaagctcaagttacgcaacatggattgaacttttccaacaaatgaacctagattggcctgaagctaaagcaaggggaggcttcccacttttagttggttgtttgtatcttgcgtgcgaatgggcgtgccgtaatggtggcgtactaaaaggcggagcaaagtcaccagatggcttcagctcaaatataatgcaagcgtggataaatggaaccgaagtaaagattccccaatggatgaacaagtggcgtcaacccatgtcatacgttagtacgacactagttgacgttggctatgaacctcttaagactcgggggttaatggagtggtcacgaggtgagctgtctcgcgaaataggtggcattgtaccatcggagacgcgaatgccattcgtagaacgctcagaaggaggctttccgttgcaagacgcagccctcacaacaatggggccacttcgaatgtttttgtgctttagcttggcgcttgagacaacaggatcatctcacttgaacgatcccgaagcaaacttttatggctttcaaaagtatatagaaggcgccctgctgtatttaggtaagcatcctggacaagtggggaggaaaatggataaagtggtcgtccagatgatgagattgctaagcgcggacctttcaatgaatgtaccagataacgtcattcctaagcaacagtttgatgacatcccatttgaagcaaacgtgcagcgcaatgtacgcctatttgacaattattcaatggcaatacttgctcacaatcatggcgtatctgtgaataaacatgagatagcaaaatcaatctgcgcacaaattcctgaaattgaagttggattgctcgagatattcgcagagtacagtggtgatgacgcagcgattcagaagtacaatgtatcaatgtacaacacacgtttgctagatgcaataacgcatcttactcaccctggtaacatggaagggtacagcagatcatgccatggatcattaccagttaaaggttataaatctaaaacccaacgtatcgtacttgagggaataaactcaagtgcgccacgtctggtggacaaatacgaggaggagctattcagagatatatttgatggttttattcctcccgacgcgaagggaatgtttgagcacatgtggtcactgtcaaattcacgatcaggtggtgcggataggattggatttaaatcaacgccgcaaaccattgtagatacggacatggccggacaatttgaggaaggatttgtatcgaacaggaaagatgtcatgcacttcactgcggcatttataatgaatgaaaaatccatgttaactagagctactcctgaaatgccttttccgctaggcttgcgatctgtggcggcacgtgtgcttcgttatatttataacttgccgataacgcagcaaataataatgcgtccaatatataagcatatcaaaaatcacatgctcaattcaccattaggatatgcaatcgagcagaagatcggagtggctgtagctgacatggcaaacgaaataaatacctctttgatgctagctcatgattctgggctagtatgcctggctcatgatgcgagcgcgcttgaccagcatattggctcaagacatagagaagtatggcgaaaggtgatgaacgaagtgctctcagattttgagaacgaaagcctgactgacatactaaaaagcgatgtaaagtatagagagcttgtggataatgtactgtcatcttgggatgacgcatatttcgagtttgcggtgccgcaagcaccatcacaattcctacatgcggatacccagccttctggagcaattaccacaggatccgataacacaatcactactatggcaatgctaaatatgattgaagcagaaacaggtgacgtaccaatagccaagcaagtatggggtgatgattgctactttgcaatgcaaatgcgatcaagcgatgatgtaatatctaaagtaaaacaacatgaggacctggccacaggtgcagggcaagtattgggaaccatcaaagactccacgagtggtagagtcgtgcattttctacaaaagttattcgtaggtggacaagtggtgtcccgtcgtatggcttatgatcatgagaacgcgcaaaaccacgaaaggctcccaggtatgattggtgaatatttagacaaggcgcgtgatttgtcaatgcgtggtgggaacctaaaattattgaacatgttacagttaatgactataattaatggatcaaggtctacagtgtatggaaggcaggcagttacttctttcgaaagtatgtccgcacccggtgggactaccaatagattactatttggattcggccaaccaaattcgaagctataccttgagttgaatttcccaaggattttcggcgacacgacggacatgacggttgatgcgaaagcagttctcgataccccaaaggaaattggcaagcgcgtaattaatgagcttactgataataaatcatcagttagaatgcaactaggtggaatggaagttaagagacctgatggtcaagactacacaatggatgagttacaattaactgcgtcagaaaggttgctaaagcgagagcgtcggcggaggattaatcttaagagctcattagttgattcttttacagaagctgacgtaatggaccatgattacgaacgcgctgtaattcgtggtggatacgacgccattggtggtatgctccgtgataagcgactaaatgccaaattcaaagaaaaagcgttagtcaagaacggattcatatcgtctagagccgacaaacaattcacaccagaagtaaaacaagttccagtaagcacgcatagaagtatacgaattggtgactcatacatcacatatacctttaacacaactcacgtcttatacttgccatcaaatagtgacgaacatttcgatctagcatctataaacggagtcatgtctcatagatataaacaacactggcatccattctacagcctccccgaaaatataagatatctactatcactaactggtatacatggtggtagggatagattgagaatcaaaacgcatgtaagtaagttctctccatctcattttagaaaagatttgatgcctgagcacgtaatgcatggaatcgatcgagtaagcaagcgcggtggaaacgtgcgagaatatcttaaatttgttggctttacatctatcggtgacaataacgaaattgacgaaataatgcgtcatgttcataaaatgggattgtatcgcgatctgtcggacgcggatgaattttcatcggtatttgatgtcgttaaatcggcctcaacgcaagtcgtaatcgacctgatctccagaacatcaccggcgctatacgccttgttatcaaccgtagactctgaagtacgtggagtcgttctaactcactatattggcctactatgcgacgaaatgaatgtagcgtgcgtgcagcatagatcgaatgcaagcggacgtaatttcattcgtgtgcctctagtgtcaatagacatggaaatctaataatttatgtagtttaaatgtaacatc

SEQ ID NO: 460 - DNA, 1761 bp, Unknown; identical to SEQ ID NO: 297
  derived from dsRNAs of unknown virus

SEQ ID NO: 461 - DNA, 1432 bp, Unknown; identical to SEQ ID NO: 394
  derived from dsRNAs of unknown virus

SEQ ID NO: 462 - DNA, 7081 bp, Unknown
  derived from dsRNAs of unknown virus
gaatttttaaattctgcctgacaaagagtcaaaacagaaaatccgattcaaaagaatcggttggtagatccaaggctaagcctaacccctactgcaaacatcccgaagtacagtaaggatgggggtgccggatccagtaactccctaacggcaaagtgctgggtaccgtgagatcgtggtcgctcccttcgggcaaagcacacgaactcgtgcaacttaacctaaactggagttaatatggccattcaattcataccgctagcttgggcagtcctcggaaggggcgctgccgtagtaggaagaaaggcggtacaggaagcagtcaaacgcggagcgacgcggatggcttcaggttccttacctccacgattggccaccatttcgggtcgtgcgtttaccgctggagacttagtctacaccggtgtcgcagttaccgacttcttcactgaccaggaactggtcagatctgaagtaggacgtactgtaatggacgtttacggcacgctaatgttggccagatacggtggctctgctgccaaatttgtggccgcccgtgcaccctctgtagctagtggggcaacacgcatggccggcgcagtttctggcagtacacgcatcgctgcttcagcaacgagacgtatactgcagaagaaatacgcaaacgcgcaaatgtgggtaggacacctccctcgtctgcagggttccttatcccaatttgcaaaactgagcgctacctcagcaactcgaacgtggacgaaagtttacgacaaatcgcgtgaggcctggatggtgctcgacaacaatggtcgtcctatgctggaaatcacccgtcagggcttccagtacctgcggactgaccaggtagcactgcgcaacgtcgccctcactggtggtacgctctacggcgccaaactcatgtttgagatggcactggtaggtgatgacgccccgagtactgacgatgaaacgctcgatgctgcgaaagttcgtggtcgtgggaaggctgtagaagtggtcggtgagtatctcgactacctcgcaaatgccctctaccccgaaccaaatgattacggcaacgatggtgaaccagctgatttcgtgcgaaagctgttgacacatccttcgtctacgtatcgttcaatggcgttcgaactcggttcgaccgctacttcaaatacaaccgaagaagcggtgctaatggcgatcgccgaggcggtgcgaaacatcatcgagccgacggattcgttggacgctgaggacccgcatctgttcataaccgataacgtcgaattactctacgacgacgttgaagaggtgaaggatggagacgctatggtctctgaagcgctgccgagtgatgacgctcgtgtcactactcgtgctgtcgctgctaacagcagttcaggtgaacgcggcaattcgctcttcgtccaatgaggtgtgcaagatgcgtacagtaacaccggacgaaatgtttgaaatactgcgttctgttccgctttcccagatcacccttgaagaaaactacgctgcagaaatgcggaagatgtgggatttcctcgttcgcaaggagacgcactctgctatccgtgattttgacggtgcggctcaatggatgggatggtatggcggacatctgaaaggcacgttcacggctcgctgggacgatgtttctcgcaacatcaacgcacgcgcgaatcttatcgacgcgtcagcacttctgccgacaaatctaacgatgctgcgtgtgcattacttcaaccacgacgctccgcgtctgtgggcagcacggttccacaccctctccttcatcaaaagtgaaggtggtaaggcagatctgttatcaacaggcttgcaatggggtgcgttagccgcgcaacctgttcttatcgacacagatgagaaacacaggcgatactggaggaatcaggaaaacttcggtcactactgggaaaccacacgtggtcgcaacgtgattctgaaaatcggtagctcactgcgcaacgaggtcatttgcatgtgaggcacgcatgtcagcctttgaactcatgctcgacggctcgattttacaaagtattggcagaatgatagcgactcccgaatcgtatatgggcgctactacctacattgtaattcgtaagagctggaccatgctgagtaggttggccgttgtgttaaccgcagcagcaatggtgtacgaaatggttaagaagtatccacgatacttcgcgatattcgtgatcatgttattggtccttgtggtgttgcctggatgcgctagcacaccagattttacccaagaccgagtgacacggcagaataccgtgatgtcacgcaatctctgcccggaatatcagcagattttgatagaaaaccggtccacacttgttcagtgtcacgctgataaagcgatggatcttcaagaatgccagaacgctctcgatgtagccgcacgagtgcgtccggcataccgcaactgcatggagtacgagaaagatcataagatccttccgaatcctgcaaatgttttcactgttcctgagatttggagacgtaaatgatcactgacgttacgaaatccgatcgtggttggcagattggtggcatcctgctcctattgtcgatcatgttcgtcgttttctacttcgctggaggtaccgagtacgtggctgaccacgcatcaacggtgtccagttacatccaaaaccagtatgaatccgcaagcgcttcgatttccgaattgctcgctgatgacgtcgtcgattccaccgttcccgcggtggaaggcgagaacgctggtgccgtgcagaggagcgactcatgagtatccgtatcatcgcgatcgtcgtcgccgccttcgctgcgtacctcgctatctcccaatatacagtgaacgcagtactcggctacgcctacgttgccggcatcctgctgttcctggcaacccgtgtgtacctgcattactccaaggatgcagactaccgcttcgaagggcgcaccttctggttggacatcgtctcgattgtcctgatcatcggtgtatcaattcaactcgctggtaaagcgttaacaatctgaggtcgtcatggaagaaacaggtttcttcacacgtcttttcgtcaaccccactgatggtgcaattttcgaatctgcagcacacgttgcggtgctcagcgtcggatccatgctcgtttacgagtggttcggactgagggaaaagctttacaagccgatgacacaggcgatcggtggaggtaattcacaggcgccgatgagtcgtcgattggcagctcccgcgccgcgaggaggaatgtaatggaattcaaacgacttgatctcacgactgaggtgaaagcgaaagaccgcaagaagtaccttatcgccggagaagtgaaaaccttcattcgtgcgaaaggcttcaagaaggtgttcacggtggacgagccgatgcgcgtcctgcccgaactgtctccccacactcgcgtcgtagtgcgaaagaacggtgcacccttcgcagtgtggacacaagaaaccgccgctaagtacggttacgtactagacgctggcaagtacgcgatggaggtgtcccgtgcctagtcgtttccaaaacagcgcctcacaggctatctgtgtagcactgatttcgttcgccgacgtacgtacgccggactattatcgtatcgcggtaaaagcgaggttcccgaaagcaactgcaaagaatgagcaggagctgattaagtacggcgccggtctggtagcgcgtgatctgcaaaaagcggacaccgtaatggacgcccgtttgaacgaatatctcgctgcccaggtcgcgggtaccgagattcagttgccacccatcgacgtcgactgggcgaaactaatgcatgatgaggaatatcgcatcaacatcaagtcgcacctgaatgccgggaacgatccactagttgatgacgccatcgcgtatgccttcaaagcgcgtaacggcgtgattcaacttgctcgcgcaatcaacacacgctatcagcaggaagcccagctgacagcacaaaaacgaaagaaatgaggtgatgcatgactgctgaagaattcgaggctactgatttcgaacagtcggccgacaccggcacaaccgaggaaccggtgaatcctctcaacgcactgatgaatgaagacacagctaagaaggttcagcaagccgtgcaaaccgcaaaagctgtgaccgaacgctttggcaccgaaagggtgctaatcggcggaggcatgatgatgcttctcgccggcggtgcaatctatctctcaaaccaatcaaaaggtaagtgaaaatggaacagaaaactaaagaaaccgtaaccctggttggcgccgtaagcgccctggcatacatgatcgtaccccaggtacgtgactttgtggatgaaaagaccaatgcctggttcggtggcgataccgccgcaacggacactaccaccgccactgacactaccactaccgatccaatcgtttaaggagtaggtcatgggatggctacgcaaactctggcgtaagatcaaagccgagctttctcggctgtggaagaaaatcaaaccctggttggcgatagccgttctcgtagcgggcatcgccctgacactgatgggggggggtgctatctggatggcaccctggttgagcacgttagccactgcgttaaacgcgaacatgctgttcggtgttgctgtgtcgattggtgcagctgcactcatcgattcagaaaccgtcgttgatgccatcggtaagattggtgacgctgctgtggcagtaggcgaggctgttggtcgcacggttggttccgcaactcgcggacttgctgatggtctgggcatcaccacgccattaatgatcattgccggggtcgcaggcgctgcctggttatttggtcttcttggatccgatgacaaggaaggcgaagcggttgtctactacgaggacgactacgtagacggcgaaacaatcgacggcgagtacgagctcgtcgataacagtgactactacggagacgaaggatatgctgtacagtgatccgcattactacgatcctgatggcaacaaacaacgtttgttccaaggagtgaaacgtgtcctttttgtcccagaagccggtcatgacgccccgggtttcctgatcacgaaaggcacggctacggaagaagcctccgttgcgcacgtgaactactgggcggacaaaacgtccgtcaacgccgcgtcgcggcacatgcgttacatgcgtcctgatctttgcatgcacccacgtccgtccacggacgagtggattgcacgaagaactattaccgccgcaactccggtcgcaacgttgaatgcgaaccgcaacgacgagataacggcggtaagacgtgtcatcgcaaaagcactgattaaggtgccagtcgggtatcgcgaaggttcagtcgatggactggattatagtgagactcataaagcactcaaatcggtgtggccgcagttggctgcgatgggttggcgtcgtgcgaatgctggtgagggttattacaaacccggttgtatatcgctcgcctttctgtacacagccgcgagcgcgaagtctcgcgacgtgtacacactggtgagaactcaggcggagatctatgatcatcagatctcttacacttattaccatacattgcaattttgtgcatactcgccggtaacgcggttgttcgtgtacaattacaacatgaatggtcaaccttcaagcttttccaacggtgctgatactgtagacggtgttacctacggtatacgaacaggttcgggtaatgcctatcccccgtattctcgtttccgtgacaacagaagatcactcttcggcgctgcggatgatatcgagctcgcggatgtggatcctctgtgtatgtggagtaaactgactggtgaatacgatagcgtcgacctggcgtcgtcgaacaccggttattccgcagacacgccaaaagcagatccttccctctatggaacggctctgcgcatttatggcttcgatgaggctgttgaaagcattcgtgtacgtatcgcatcgtatacggttgctcaagcagattacgatccaaattgttgggtggtgacgtaccgtcgtgctcccgttatgtcatttgcgattaacacgcagaagatgtacgagaacatgatagatttcactactaacgttaaaccggatccggacgcaattgcttttgccgaaggcctgcagcaaatggatggttacgccattcatgccacttactttacgccccaacctgtgtcgcagaatgtgttgtatcgcacaaggatctacaacgacatcaagaaagcgggtaaattgggtgagctggaccgtgtattgggtgcggatgaggatggtgcgaacatcactttgaacaccatgaataaaaaggtgaacaaggtgatcagtaagtaccttaaaatcggtgttttcgcggttcccgtgaaaaacaacgaaatcgacataccacgtggaccgatcggagatctggttattgtatcagagtctcttcgtgccagtgacgtcggtcacattcctgccttgggtggtttcacaccctgcctcgtaccaccaggtgccacaaccgctgatccaacaacatgggtcgcgataacgtgggcggaagctgaagagaagatcgacgacgggtttatcccgagtgagtaccgtgccgtcaccgacgtcaacggtgctgtgactggttatagcgtgcagtcactatcgatcgagacccgcggcgctctcaactcctctggttacatgacggaggaaattgatgctagtgctgtggaccccgcgtataatcttcttcccgaagaagacttgcactcgttgtcgccatacgaacacatggacacgatctatccgttgccgatcacgtcatccgaaggcttgactaactcggcgaggacattcgcgttcgtgggaacggaaggttacgacgatattgtgcaagtagccgctagagctatttacgcgtaatcgacaaatttattttaactgcatttgcagtcgccatatttatggcgggcccctaggggccctttc

SEQ ID NO: 463 - DNA, 1157 bp, Unknown; identical to SEQ ID NO: 343
  derived from dsRNAs of unknown virus

SEQ ID NO: 464 - DNA, 1149 bp, Unknown
  derived from dsRNAs of unknown virus
ggtttaaaatccgtacggtcgacgatcttcgggctacttcaaacgacactgttagatatgtttttattagcggaggcgaaacgctacttatcacctgttgttggggtcactgaacaaactttggttgaaattgcaaaacgtgaagtgaacaggatcctcaatggttatagattatctgataaaggctggttggcgcatggctcacgagtgtattttctgttgttacgtgcagtcattgagccagagccgcatttagatggagcagtggttaacggtgatataggcaaacgaatacgcgagttgtttcgggattggtctatgttttcaggtggatcaggagctattcttggtttggctcatttagcgttggatagaactgtgcatcagacaagtgggctggttcgagcttcagattggaccaggtcgtatatcaaccatggtcctgtgaaaattgaattttgggaaggtgaactagatatgtatggtcatgtgaatgatcattggttggtggtgcgacacgcaaccaatgatcgttcacttagattcgcgcgacatgattttacgtcatgcatgtcgtctgtttcaggcgaggtgcaccctgctggtaagttgttacgtactgtcgagacaccatattcattcttcgctgttcagtcatttatgaattcggaattctgtcacaagcacttacctatgacaactgaagttgcatgcgcacaagctatggagatgctggatggtacgagctggccagagatgggtaatcacaaattgaatgtaacggcaccagaactaggagatgcagatgccgacattgacggtacatggtttgctatggcgtttggcccaaccatagaccgatacctgccggtcttggatggggcagtgtgtggcgttcgggccattaccgtgtttggacatcgaccattactaatctcagttaacgataatcgacaactagtaacatgggatcgcaactttcgagttggtggaggcatcgcgggagaagaaataacagttagtaaggtcaagcagatacaaggatctcatttcgcaattagtgctaacgcagccatcttatcagtgtccgtattggggttcgaggagggttaagtcccccccgttagggagacatcatggagaactgac

SEQ ID NO: 465 - DNA, 1523 bp, Unknown; identical to SEQ ID NO: 335
  derived from dsRNAs of unknown virus

SEQ ID NO: 466 - DNA, 2809 bp, Unknown; identical to SEQ ID NO: 349
  derived from dsRNAs of unknown virus

SEQ ID NO: 467 - DNA, 5261 bp, Unknown
  derived from dsRNAs of unknown virus
gcaaagaaagagaagcaatgatctttctgcgcggcctccagagatgggcttagttgcttgcctctggggggtgttggaggggcatgtcttactgttcgtaggatatgttgggtgggccaacacgtagaagcacttgtgcttctcaagctgacgaccatgttgccaacgcactaagtgctttgcattcatctagaagtttgaacaacatcttagcgctctgcagtcaagtcctaacgtacttggctcagtgactgtagagacgccgtcactacttgcgacctgaactgctgtcaaggcaaggaaccatgcgaccaccctctcgtgtgcaggtcaacacaccaatggcctgaaagggaccggaggtgctagtttgtgacgggagaagatggactacagctaaccattgtagaatggggctgtgcagtgcggggagagtgcccacattgaagcaaacaactagttgtctacttagggctctgtgctacggcctgtccactacctgctccacgcaatgttagaacgacaacaacacactatcatgtcaaatgcaaccaatgaacaagaagggaacccaacttcaaccactcaaaacctcgatcaagctctcgatgcgcaccacgcgctaaatgagccagatgacatctcagccgcctcatcagcagctgaggaatcatcgaaccaacaaacatccagtatggggggatttacctcattcgacatagcacatcgcttctttccagtcagtgagacgtcacgacggatagtctcacggtttcttcacgatccaactgcttcttactacaagttattaagaaacatgtactctacagctgagccaattaacgactggctgactccaacacatttggacgacttcgacgcagagaactacgacttggacgaggagagtgaacacatggcctccctgcatgctgagaaggcgttagtcgaacctgcctttgttcactatgctaacattccagggcaaaaacttgctcttgacccagctgtgatcactgatcaagtcggtgccgagtcagtgctagcctcaaagctctttgaccctagatcgcgacagatcatccaggaggtcagagccacatctgaggcggtctcggtgctcaatagcgcactgagccatgggatcgggacttcaatggctggtcctttgtgcaccatgatgacagccttcgcaactgagttcagatcgctcagccaggtactaggcatggggtgtgagacacctgaacggatcgtgttccacaaagacagctttcagagcacttggcgaagtcagtcgtccttcgcggtctggacgtctaccggctggttcatgacgacacaaagccactacatcgagctgactgacggactgctccacaagccagaccaagctgcactgtggttgttcgctttgacgttgagacgagtgccgtttaagacggtgcatgtgtacaactgcccgatcaaggcaaagacgatcacaatcagtggaactggacagattgaggttgttgatcacgaaccgccgatcaactcgcaatctggtgcagatgagtctgatctggaggaggacttaggagtagaggaggagactgagactgaagaggctgacgaactaagtacagaagatgttgactgggctgtcacgctggtcaaacgtctcggctctttgtacggacatgaggactacccgattgacatccccgtcatgatgcgagcgcttgggcaggtgctacgctggtctcagcacttactagctggatccggaagcacaacagcagcctacaagctgatggccgcaaccagctacacgcagttctcagagtgtgagagcgacgaggggaagacgtgccccaacttgcatctcaactgctggaatgcgacacctggttcaaccatcaccgagtgcagtgcagtcaacccgctagtgctatgggcctacatgaacaggatggttgctcttgatcctcaagaggagccactaccgctcaacacaactccacatggtgttggcatggtagctacagtgttcaacatagccatgcgagcgcatagcgagatcgcgatctcacaaggtggactagacgcgtacttcacattggctaacctgccatcatcaccagacagtgagatgcgctttcatcaccaacaactagtgcaaagcagcattgactcacactcctctgtcacgatcaattgtggcatccggactaaggtcggcaaccctgactcgttagtctgtcaactgtactcagccttcataggctactatgctaggaacaagccctgcttgtcagccaacaccctaccactctggcttgtcaacgtgctatcaggcgaagcacagatgatgccttctcgaggtgaagtgactgtttcccgagtagttgctcctcctcctcggtctggtgatggtctagatgacatggtcaccgagacaaccgaccatgatgtcttctggacatggggaccgagctttccacgatcaccagacctctacacttacatagacggcaagtacggtaagccatctatgctttgtgctaatgcttacatccaaccagacgtctacaacatggacacttacagtcagactgctaccatgatgttggttcctaagcactacttgtactcacatatggtacgcacctttgctatgacaccacacgattgcacagcagagtgtgttgcacccctcactcacatgcggatcccacaaggatcggtacctgtgcgtgaccgcccccctatgatgctgggggatgcggcttcccttctcaactctgcttttcgccgagttgtggatggaaaccactagagtacaaacttctgtgccgagagttggcatcactgacagcggactagaagtcctgcgacgctacatcaactacccttggttaccaggggcagttgtggccgcgcaggagttcgctgactttaagacatcaatctcttcggctgaacccgctccctgggatgagagctggttcaaaggactacagaagaagtacagaccaccagaggacaagtccaacctctgcccgctagcaacgggcatcccaaggcagcagatgggactggccctctctctgctaccaacaaccatccgcaaccaagtgactagcacttggatgcacctacacttacacacactcacaaacgggcaactgttcattgccttcaaaacactcggtgacattgctaagcaccatggcaatctactcttcccagggtactggaccttcatgatcgactggaacttgcactttggggctcagccaacagaggacactgatgatgagttcactgatctgatcgagtcatgggtcagcacgcctaagccagaagacgcgatcggatcagatcgtgatgtgatgatcatgcgtggcttggatcgacttgagtctgatcttggtagaccagacacacctggtcaaaacattgatgacttcttggcctctccgtcatcttggctaagcaacggggcgtctgactcgcggaagctagaaggcactcgtgctactaagttctcaacctatgcagcttcaacaaacgcgcagctacacacagacatgttcgacccatcatgcccacactatcgtgtctttgacaagagagagaagggcaagcatcgcaacttgatcagctcaccttggtctctcttcctacagatgtcattcgtagggcagcaggcagagagccgcttcaagaaggtagttccgacatccttgtcgaatgactggactcctgagagctggttgcacatcatggacatgatgcgcactaagttgtttgttccgatcgatcaaagcaagttcgaccacgttccaagcaagagggtgcttcttagatgtgcagagattctctgcaaatctgggacatgcccactagacccagaacgtgagatgatctcaaagttgatcttagacagactagctaatgcgacgctatcctacaacaacaacacctactcacaccagagaggcttgttgtctggatggcgctggacgtcactaatgggcaccatgatcaactacgctgagtacctaagcatcacggactccttggctgtaccacgccaactcaaagcaaatgtgtgctttcaaggcgacgacgcactgattgcagttaatgactgggcagacgctgtcaagatagttcagcgctacatggaagtgctaccggtcaatccaagcaagttcttcatcgacaacaggcgctctgagtacctgcggtacgtcatcacacgcaacagacgtttagggtactaccctcgtgctgcttctggcatcatgtacgctaactcatgggcaggcggagctatggaccctgcgtctcttgcttccaactggagcctcctctactcgagaggtgctgacgcgaaggagacgctctacggatgcgctcgtgacctctgcggactattgcgatgcaacgttgacgaagcactggacctcatccagacaccgtcgtctgttggtggactgggctggtacgtgcctggcttccaacccaagacatggcgtagagtgccgttcgtcaagcgcactgagatcggcaaggatcgcttagtcattgagaccgactacgacaacatacccaaacacacacgcactactatggttgcagccgcaatgcaacggggacattcacgccctatggcatcgattgtagctcgcagtctatcgactggactggttggcatcgcttctccagagcgacccaagcagcggttgatgagctacgggagaccaaaggtcttcatagcttcgcgtgcacacacacaccacacaccaaggccgccacaaagcctgctagacccgttgtacgtcaacgcggcggtggcatctctcgatcgcaagggtggactgcgatggactgatgtcttccgttccgatgatgttcactggttaaaggcgcgaaaacgcaactggggaatgaagctgttcaacaaatggagcactggacagctctccggttacgccgggaagcgatggggtgatgccccagacttcttggctgtagtgcgtagacgcgttgaagcagaaggcatcttgccatctggacacatgtcgatgcaccgagtgacgactcggctgctcgagttagagctagcttctaggttctggctcgtcgacacacgtctacggctaggtgcataacgtccgaagacgctaaactactgcgcatggagagttttccgtgctaaaaaacataaagtttttgctttatgtccccaacagggacataaaattttt

SEQ ID NO: 468 - DNA, 1886 bp, Unknown
  derived from dsRNAs of unknown virus
gaatatctcaacgacgattacgacatgagcagtacaaaatctgatagtgtgagcaaacagaagagcaagaaaaatcacaagatagatcccaaattttacataactagaagacgcgcacaaatgggttcatttgtcgtagcagatgctgagacaaacatggatccaggtggacatatagcaaacaagttacattcccgtgtattcatcctaaacggtgaagaacttatggcgatgatggaggctcgaaactacacctacgagcaggccatttgttatgtggaagcggtgtcccaggttccagagcacaaaaagggtggcgttgcatatactggtcacgcgcatcccattacgacggttgacccgggtgaggttgacatactaaacgcttattggttcgataactcatggacaggtaacagttggacggctaatgccatgatgccagacggcgggccaccgtgtttctggacgaaaaacatcgcggcaccagagcaagacaacacatatgtattaggtggtaagagaggcacacactccaaagcgatcaaggcgaagttagtgagggaaggagtgccttactacgttgatggaacaaaccctagtgacttctccaacgaggagcgatcgaaagtggtgccaggaacttcagtacacgcggtgaccggagtattcgagggtaaagagttcgataacaccacagagcaacaccatcttttccatgacgacatccaggatagaaatggtaaacagtaccttatccttaaacatgatgccgccatgatcgagagagccatcaacagcttctccgatggtgttgatgtgatcaagtctgacccgttttccgaagcacacgaacgatatgagaagcaattcccaaatcgcgggtggaaggttggatatgatcaacatccgacctttgatgatgtgtgtaacaagctgaaggcatttctaatgacgtatccgacagaggagaagcacatatggattcagggtgagcttgagaacatgacgacgacagaaacgataagacgactgaaatctgaatgtattatagcattcactcgggcacgttcatcaaacgctacaacaagcccaaccataatgacattttggaatacgccaatattggccagccaagatttagcatatgcatatggtggtcgtacgccccagcgtatcccagtgattccctggcgtccgaccaacttcggaatgaggatcatggcgccgggtttgaaaccacagctgtttccatcatcttctctaatgagggatttaggcattaagtttagcaccctggagatgaatggatcgatatcgaagccagtggtgtatacaaactattcgggtttcgtcaaattggtgcctctgagacgcgagctgaatatggatttcggctggcttccgatgggcaacaatgagtatgcaatggccaatccgagggaggtgagtcaaccactgtttatggtggaagacgaagccttcttcatgggtctagggtcagttgtgacaggacaccacagcatatatgggctggggagatcagagccagagttatgggagcagctacagcgtaagctgaaaactggtcacgatacctccggtcatatgattgccgcaccactagcgtataaggcacaaatgttatggtatctacaagaagtgatgataaacatgacgcagaagcgtagtatctatagccttcctttcaaagagccgacaggaggggtatatcacactactacagagtacgtacatgcattaaacgacatgaacaagcttgatcggggccgcgtatatccattctatgctagacagaatgtttcgatatgcgcggactttatcagagctatggcgtaaggggaacgacgattgagtgatacatc

SEQ ID NO: 469 - DNA, 2818 bp, Unknown
  derived from dsRNAs of unknown virus
ggaaaaatttaatatcaacgagtgatagtttttcaagttccagctaataggagcgattaactttaaaacaataattattatgtttaaagatcaagaagacccaagggcatttttacctaaatcaggaaatgggagtatcaaggaagagtggaagccgtttgacaactgcactgctaagaaaagagttaaattagtgttgggaccttcgtccatagggaaatcatcactagtactttatctgaacgaaattggaattcctgctttggatttagacgctgttgggtacaacagaaaccagaaatggtttacgtcatctttagtggaacttgcggaacgaaagagtctgcacactatgattgctgtaggaactacagataatttagggtccattactgatgaattaatcgacgcaggttggatggtagagattgattttttaatcactactcagagtagataccgtgagaatctactcaaaaggtgcaacgccgcctttgccgacactgccttaataggacttccattcgaagcccagaaatttattaacacctttactgacggtaaaagtaaaccaaaaaattctgaagaattttttagtcttgtttcaaaaactgaacccttaacggatgatgtttttgttgatagacttttggctaactttgaaaagtattcactttcactaagtaactctaggcattttaactcaccgcgtttagttactgggaagtatttactttttaaccgctttgtggatgacaaaagaaatgggaagcaaaatgtaattcccgttcctgattgtatgagacaattagactctactctctatcaccctgcggcaactatggtaagaacagatttagtattgtcaaaaactaaatctcgtgttgatatttttatcgatttaagtaatgaggacgccatgagtactttttatcaagatcttttcaaacgcgatggatccaaaggtgagaagttcaatctcgtttttaatttctcaggcggttacaaccacattactcatcagatgatgcactttatcaaatcaaacagatcgagattaagtgttgagttcaacagttcatatgcgcaatctgcttcagctgaactcgcggtgttttgcgcgcgattaggtgttcttaaaacggaactgaagtatgttgatgttcacgcgactatctatcctgaaatgggattggtgactgatgtggacattcatccaataagcgttattggtgctaagcagacggacgaatttcaacgcatccaatttggaacagcaattaactcatactggattcaaagagaaggggattctgcaaacactagaaacagcgtcccggacatttctgcttgtatgagagcatcatcattattagccaaatctacaaagtaaattgacaatttcagtagatcgagtaattcttgaacggtaacggtgccggcttgtattaataattatgcaagtgatcgtcgatcctagatcgtagatcgaaaaatcaaacaatgtttaaaaactaaaaaacaaatattatggacaatttaaatttaaaagctaacaagtttaacacattcttttatcaagatgtagcattattaaacagatattgtattgaaaagagtgctatgctaagattacttagtaaaaagcatactagaaaatcatttaatgttttcactaacgacgattttagttgtgaattatacgttgggcaggatggattaattaacgctattgacactatgatcaaatttgattgtcaagagtatccagatgaagctaacaacttggtattaattgagagattggataaacttatacattggcttcacaaggaattagacgaagctgcgaacgcgcacgaccatgcgaattacattgatgaatgttttgattgtcttggccttatagctatgataattaaggagtatggtttaggagtaatgacattttacggttcaatgctttctagatgtgcacacgttctaacccctatgattgaagtatttagtactattaacgaaaatactgagacagatgtaatgaataataatacctgttatactttaaaaggaaaaccaacttttactagtacgaaagatattttatacttactttcctttaaggaactatgggatgacaaacagatgcgacgaaaccgcgagataatacctatgagatttattgaacaagctatgcatttagtatgccacaaagctgttcatcactcattaaacaattaaatttaaataaactttaaacacgtaaaacaaacactattatggaaaatgacatgttttcaattatgggtcaaattgacaccatagtcccaggctttatgcaaggctactttttacttccacatccaggaagatttgatgatatggatgagtatgaaagagtgtatgacttattagttactaatgagttaaaatacattttgatgacagatggtattaaaccaccggatatccttgaattaaattttgaaggtttacctgacgttcttacagtctcaactgttaagttcgggaagaattcaagattattaatagcaacagatgaacttttaaatgacgataaacagtcacactggttatgttctagaggatttaattattctaggaacaatgtgatagcttatcaaataggaatttatgagggaaattctaatcttgtatccttaattgaggaacttaagtagatagtttttattttatagaagaacgattggcatcttgaatgtatagacgtttagttaacgaacaccgggagatgatacggtgacgccacaacagccctttatccggctgtttctcc

SEQ ID NO: 470 - DNA, 1702 bp, Unknown; identical to SEQ ID NO: 341
  derived from dsRNAs of unknown virus

SEQ ID NO: 471 - DNA, 1742 bp, Unknown
  derived from dsRNAs of unknown virus
gtaaataaaatcaaccctcccactctatcgaaatcgtataagtacatattgtggtatttacctagagagaaccgatttaaatttaaatagaaagaaactatggcaaagaagaatatgccaggatttgtaggcccaatactaccaggtaaaggtcaagcaaaactggctattagtccacaaactccgtcacttaatgcgctgcaacccggtacttctactaaaggtgccgatattgctcttaaggcaagtaatcgttcgcagaatggtaacaaaggtgcgggtagaaaagtaacaacaaagaaaggtaaacaaccccggaacatggatgtaccaccaaaatatactgctccggagttttcagatagtagtagcagcagcagtagttcagatagtttccagcaagattctaaaagaacaatcttttatgacgagaatagagatgcaccaattctcttcgatctaaatttaaaagatacaacgactccaattcctcttgcacctgtcgaacaagattatacagcaagtactggaaatagtgattctagacttataattaatcttgctcaatacgctagaaattataacggtcaagcctgttcaacagctggttatcccgtttatgatcattacgttatattatataatcaaatggttaagaaggtgtatgcaactgtaagaagtaaaattgtagacgcatttacttttgctaatttctataattatattcagttaatgactgcagctcttgagctattttacgctactgatgccatcttatcgtatacttctacaaaagaggagaagaacactggagtaatgcaacttcagcgtagacttactgagattgatttattcacatctcagaatgagttaagacgcttactgaaaggttactggtttccggaggagttttctaaactaatccgttggacttatcagatttataagacgtccgacaacgatcaagcatgtaattacatgttcatacctaatgaagtatatttttacacttcctcttcaatggatgtcgcgacagcaatcaaggcacaaactgatcatatcattggtgaacttactactggtacatcagcatctaactatgttaaaatcgtttctgtccttgggcaaagctatccagaaggtcttattgaaggacttccatatagtacaaaccgcgcgcaatacgatccgcaacattacgaaattttcactaatcaacccatactctataaagacgacgcagttgacaaagtataccctttctcagctaatgattcaaatatcatgtatcaaagaagttgtaatcccggtgttcgttcagggttccctttctgtttacaagatattcacgctcttgaaacaagggatggtgtaggtagtattgatttcctttcctgctatatgcctaccgcatatcagtcggataatgttaatttaataactaataaatatgcattaactgaaggtggttactttagaccaagatttggacaatatgttcttaacgaatctgcagacgcacatgttgttcatatggcttatacatcttcaactactactaattcaatatactttaagaaatccagtgtagcatctggcttccaaagagtatattttgataacgcgatggctccacttatcaatctaagagaaatgatggacgctcttttcgaatttacgatttaacttatttccgggtttgtcttactgtaatttagaacattagatgttctaaccccccc

SEQ ID NO: 472 - DNA, 2071 bp, Unknown
  derived from dsRNAs of unknown virus
gtaaaaactaaattaaaatttaaaattttctagaaattgttattacatttctaaatgtgaacacatgtactctacttgtcgttctagttctcgacagagaggttgctctaagtgacactaaatagataaaacttacttatcaccattaatcttatggctaagaataatagtactaaccctaacagacggaagaagccacttcaaaatctaaacaataggacaagaacctttgttcagaaacaagcgaagaaggctccaagagtcgggaaggctataaaagatgttgctaatgttgcgaaagcaggtgcacaacttaacccaggtcaatttggagaaatggctgtcaatacatatcagcaatcacgaaaaggtaactatcctttaagtggtacttacaatgtaactgaagccatagtctctggagttggagaaagtgcagttgtatcttctaacaatttaatgcaattatggaaagacgtaggtattggtaaacctgagcaaggcagaagtacttcaggtacgtattctgacccttcttttactgctaatcgcgatagaagacaaggaccaactaactctaatcaatctaatccatcaacaaatatgccaaataggaaaagaggtggggacgcagatagttctcatccttcaagtcagtactccggtgatgccagttcggcacccattaatcctttcaacagttctgttttaacaggatcaccgattaaattaaattcatatatcgataaacagtatcagatgaatccttaccaggatcaagtcactgatattggtaataccgacgctgataattctagtcaatttaaacgcacgcacgttaatgttattgacacaacaaatggtgcactgtttaattttgaaggaaactcacgaatgaaagtctcattcaaccgtatcttccaagacttacgacaagaaatagttgctgaaatcaatgccaaccaattcactgataaagtgtttacaaaggtaaatttcgatagctatatcaaaactgtctcagaagcttgggctttactggctgaacttcagactcgtaaaggttttgaatcatcatatgcagaacagaatttaattcttcgcggaatttctaactctatggcaggtaatgtcagcttattagttgcaatatcctcgcttgaaacaatactaaagaaatttgcccttccaattaaacttattgaatattacaaatggcttgctcaagtatataaatgtacacctgttgaaggtggaaaacactatatacaagccagtccgtacatgataagttcgcttcaccaagctagaggtggcttagatgattggactgatttaataattaagttagaagacataactgatgcattatactcgtcatcaacatttagcacaagtagtaacacaggtaactggtttacgctatctcaatatttagtgaaatacactagtactgggaactttacagatataggtaattgtatgtcttattgtactcaaccagtttacgatgttaatgctaatgcaatatgggataactgtgtatcatatcaaggtgtcagtgtagggactagtatgtttggtcgcttaagcataccaaacaacgaagatgcaatggtagctttcccacacgatgaagattgtgtgcctgcttacattacttctcatttattaccactttgggcaaacactgactttaccactggtagtggtcagacaggtggtttcccattctatggtacttacatgaaagatgttgcttctattcctgcggcagatcgtccaacttggcaacctgaatcaaataatgtaatattatttacatcaggcaacagttggtcagttgatgttgttaacgaatcatgggattacattactgatcacatttggaccgttcaatacagctcaactggtgatagaacggctatgaacatgcctaaaggtatgaacactcgttactattcaccttcttatacaaacacaactacagcaagtgtaaacttaatgtatgatatgtttggtattccgttagattttggctaatgccagactggtacgtaagtaccagttc

SEQ ID NO: 473 - DNA, 1674 bp, Unknown
  derived from dsRNAs of unknown virus
gtaaaataaatgaaataaaactgacgtaattatagatatcttacctatgcgtggactcaaatcgtcaaactttgtatcgggatattcttctcgaccttatgtcgcacccatattcttcaaaattacattatacatgaaacaaccaatccgccaagttctttccgaacttaatgcatcttttgatgctattcgtagccttgcccgattactagagagaacaaaggatggtagtgatgagatttacctttctccaatcggtaaagcccatggcccagaaactattctcagtggttgggataggatctttaataataatcttggtagcatgaatgatgttctacttagtttagaagaatcaaatcgttccaaatacggacctaggtctatcgcagccccatggtcggaacgtgcttctggtatagaaaattccttttcagctgatcaaggaaggaagattgaatccttcttaccagatagcggtaggttacgacctatcagcgaagataaagctgccgaatacattaagttacaaacgtcagcaggactcccaactatgctaaagaaaggaaatgtccttatggaaacacttaatacacaatggagccgctactcaacaaccgatggagagtggtacataccagctgttccttttactcgaactcaggaaaataggaaaactcgtcttgtttggggctaccctctagtatatgttctagatgagatgactttctacagacccatccttgaggtacagtctaagaaaccctggagagcagcgcttcgttctgctgatgacatcgactcagcgatcactgaactcatcaactacgctcgtagtcgtggaaaggttcttctaagtattgacttttccaattatgacaacactgttaaggagactttgcagagttatgcttttaatgattactttatgagtttattccagccacaatacagatcccggttacaggatgactcggaaagatttaatagaatacctattataacgcctgatggcatactttctggtaaacatggcattccatctggttcagcttacacgaatgaagttggatcagtggtgcagtacggtatctcacaaacttttgatgagaacctcgagatatttcagatccagggtgacgacggagcttacgctaccttcgatcccgaaggtttaaaagaccatttccgttcatatggactggaagtcaatgatgaaaagtcttacatatcagatgattatattgtatatttacaaaatctttatcatactgactatattaaagacggtttaattcgtggaatttatcctttgtaccgagctttactgaggattgtctaccaagagagattcaatgacttttctgaggatgatattagtggtaaagattactatgcgatacgtactctttcgatacttgaaaattgtaaagcgcatcctttatttaaagaattcgtcgagtatattgttggactagataagtacaacttagactttagcgaccaaggcctttcatcatatattaagatgcgtgaaaagcaagatggtagagacgttaggttcacggagtataagagaggagacgggtttggtatcaaatcattcgaatcttataaacttgctagagaacttattgtttaattaatttcggtgtaacacttttgtgctacatc

SEQ ID NO: 474 - DNA, 1481 bp, Unknown
  derived from dsRNAs of unknown virus
gaatatactctgtagtaatatattatttgacaaaatgaagcatgaaacgaaaaatcaaagttcaaaaggactaagcagtgaagaacgcataccacccatgtatgatcctatggatcttgcaaacggtagctatggaaaacatattgagaagtatcttggtaggagccctatcgatgggcctccgggatatgttttccagaaggtaacttattctgcaggatcagcggcaggaaaaagtgcggtcgccggaatgtacaagctctgcccggatcacatgggttatatttacaacaactcggacagtgtgatgacgattccgacttccgcagtagatatttccatcgtcgttgttgttccaacaggcaacgtcgatgcgggtaacaacgtaattggtgcgagcgcgagcttggacattgtcgttggtgattacgtcacttacaatgcggaaggaggtgccactatgggcggtcttgttgatggcaaaacgtactacgtcaactatcgcaatggagccacattcgcggtgtccgaaacaacggcgggacccagctacgccacgattgacattactagcacaggcaactccagccagacctttacattcaatggcactgtaacatctactgcgcatgggctgattgcaggggaaacagtcgtatactcatctaacggaaccgcaattggtggtttggttgatggtacgacttactttgtgcatttcgcaaccgcaaacctctttacccttgcacttacattggctggcagaccgatattgctaacctcaacggggaatgccacgcaaacattcacacatgacggtgaaattcggattaaccaagatggtgctgatttggcgtctggaaacgatccgacgcccgcaggcatctcaggtgaagccaagcttgtacctggggacatgatcttggggagcattcttcaactgatcgacacccgatcgactgagaatagaacaggattcgtaaccgcaggattagtttcaaatgattccgctaccccggactcgtatggccctgagctcgcgactgatccctcgacttttatcacagggagcgcaatcagtggtggaaagacgcattcggcggcacgattgtcagctctgtcagtggcgagtccgaacttaagtatttacagtcctactattgtgtcaacggcggttaatgatctggctccagcaagcattggtgcaccaatcaatgcgattaacgtgtctggaatttcgagcgggcagtccaaccaaattagatttaaccttacgatttacgctctagtcggtgccaggcagaagacgatttctcattatacgcagccggatccatcattcagaatgtcttgtctaaccaggcagtacgctgaacatccagtttctttgattaattaaaaacataacacatcatgttaattaatgtacgactataaatgcagttagtcaaactgggttcacattactgagttgaaacatc

SEQ ID NO: 475 - DNA, 880 bp, Unknown
  derived from dsRNAs of unknown virus
gaatatcttgttaagtacagaggaatgattgaagtagttcgacagtacccgatcgtaagtcatggatcagatgatagtatgtcacctatcaaactatccattagcgaagaggaattcgaagtaagagagcatattaaaatgcaactaagcctctacaatccaaccacccacacacacgtccccattcatctttcaatcagtcaggttaacggtaaaactaaagtgttaatagttgatagtctgaacgcaactgaacttatcatgagagatgaaaatgtatcgataaacttagtcaataagaacaagattaaattatcagatgaagaatcaattgacccatggtgtgatggtgtggatcaggaaccgaacgaagaaggtgatgaagacgcagaaacaccagcaaaggctaccgctaatgcaataaatgtgtcgtatacaccagcgtcgtcaaggactccagcgagctctattgcttctgagccaatggatgcatcatggctttcaagcatgtgcaaaagtttgtaccctcatagcgctaaactcaagagcgatggggggttaacagtaaagttcaaatcaggtggaaagatgatttcacgtaatgtctacatcaagatggtaaagggcaaaagcaacgaagcttataatatggtgattatggcgaagaataagccagcacgattgataagattcgatgactgggagaccaagcgtgagcccggctcacccgtgttacaagacctaatgctacaagatatgctacccccaggaggtgagggagatgtattgcgtagagtatttgaaaggttggtagcgttttagtagttctcttgtttcgtacctcgtaactaagtacgtattttaacgagtgaaatacatc

SEQ ID NO: 476 - DNA, 1014 bp, Unknown
  derived from dsRNAs of unknown virus
gaataatctctatctcatagaagtttacaatgttctatcaacgccatgatctcaaagtaactgaaacaggagcgtcgcagtcacgcagcagcgccacctgggtcacgacaaactccgagatccgtggtatacgtattggaggagcaagatggaatgtaacagtaacacaagatgcagatggggtagcgcgagtgacgatcgaggatcacttgaatggactcggaagcgagaacattacagtggaaacgctggacgcaacgcctactcaaggcgacggtgacaatctagtattgcgcattccctcacctgctcggttagaacgagagaggatatcggtcatgcagacagacgagtcgacatctgatacaggcgcagcgacgttattatacgaagctgaatcaaacgccatggatcaggaagcgccatcggatgttcaaaatgttggctccgcaatgctaggtaacgtcaagacaccagctcgtctgtttcctgaaacagcagagcgtaaagtccccattgaatcaggggcagcaggcgttcaggacgctagcgaagcgggcctggcatatggcatcgatcccagatgcataaacgttcgatccgaaactgcgtccgagacttcatcaattagcatgcctggagtggacagccaagatggttcactcatccgtcagctacttgaccgcaaattcggcgcaaacaaggtcagatatggaaaaagtataagcatccgtaaggcgaagatcttcgccacgcgggaaaagcttgacgataataatttccataaagtgactttcttcctcgccggtaagcactcaaagcgtacaatgatggactcacccctcgacataaaacgaggagatgtcctcgaattgtcgctgaacaacaggccgccgactccaggaaaggaatccgagcaagcagacaatgaagctgtacttcaagaagtcttccgatgcgtcaccacggtgatcggagcgtaagtgaacacatgtagatagggacgaatacatc

SEQ ID NO: 477 - DNA, 1761 bp, Unknown
  derived from dsRNAs of unknown virus
gtaaaatttaaaaacttattaaatttcttatgaaattatataaaataatccatggcacccgtactcccaggttattttacgaatacacagagccatcgagaacagctactcaacttaacaaacaaagtaaaatatggtattattcaataaaccagttcaacaaggtttaggaacaaacactaacttagttagtccaaatgcaccatttcagagtttagatcgaacaccaaattcggtgttaggccaaggacaaatgaatatgtcttcgccacctaaaggtagtggtaacaaacgttacacaccaaacagtaaggcaaaccacaaagcatcaggtagtcgttcaggaaataagaatttccgtaaaacacctactatgattaacaatgacaatcgaaaaccaaaaggttttccgcttattgtacctccgtttggcaatgacagcaattcgagcacaacaagtcaacgctctgatttcagttatgatatcacaggtcaaccaacgagtacaccctacagtgcaccaaaagatgatacactgtttaaagattggaaccgagctcaaactatccctaaaacagggaagaatggtgagaccaatgctgtaacaagttacacaaagatcttaacttgcgattttaaagatagtatcttagatccaacgtatagaactgagtgggacttaacgttcaataacatgattcgagatgtaatccgaaacactaatgcatccaaaggtgctttagacgtaatgactaaagatggtattgcggactacattcatgaagtttcacgattatttacatacttatacgaacttgaggtattaatgggatgggacccatctggacatgagaatacaaaccgagtacttcgtcacttagctcaagaattagctaacagtactttccttgactaccgaactcagatgaaagaggtcttacgtagtacagttctacccctacctatgcttaagtatttaagatggcttcgtgagtataagaacaaaaatgagatgccagaatctccaaagattgccttccgaacaacttctgttatggacttgattgacaaggcttacactggtaattcaactgcagcatcacaatggattggtaatgttacagcatctattcttgcagtccgagccttagatccgaaaattccggctctattactagataaggttgattgtgtggattttgtaatggttaaagattactatggtaatgcttgtaaccgtgcacattacgatgctgagttcaacaacatttacaataaccgattatgggctcgaggcgactttggaagtgcctctacattcccaatggttaccgacacttctgtggcggcattcaacactgtgaaaccagaagtattagctctagctaatatctcaactcaactaggcctagatttcactgcggatttaccgatggaaaatcgtggcggacctaagaatttcgcgaactttagcacttctgtagcttacagtcactggtacacatgtgatactacagcaggcactgatccatttgcttttaaagcagtagttaactggtttgaaaccggcgatgactcgacgttcatcgttgaaaataactctttagttagaggtattgcaattcctcgcggagatacattacaaatgttctaccctggaagatcaaacattaacatggctaagcgtctagcttttgctcaattattcaatcaattataataataataatagtcttcggacgggtagtggtttgccacccc

SEQ ID NO: 478 - DNA, 3744 bp, Unknown
  derived from dsRNAs of unknown virus
ggaaaaaggacagtacgatgcagagtgcattctcccgaacccctgaaggaaaacaggaagaaacccctagaagctcgggaagagccggactaggagatgggagtacatcttcgcgctatgccgcacgcatatccgcctctgtcaagtcgccaccacgcttcggacgaaccccgtccgtagttgatgaagtcttctccaaacacctccgcgcgcaggcgggggtcgtggagggctccaaagacagcgtaaaaacgtcaatgacagattcgcggcaaggtcccatcgctgagagacatactcagcgagggccccgagagctcgctactctcggaacaagcgacgcacgtgatgcggccgcgtcaatcagccggccgtccgagaggacggagggctcgaacgcagctgagcaacaccacgtgagagaacggactggagtcgtgcccagtcaaccagcgcactgcacagatggcagtgaaagagggggtaagagaggtgcgcccccgagcaagaaagaccggctgtctgaccttggactgcacaccacccacagtgagcacaacaggcttatgcatgccacccatggtaatacgtccacgggagcaaaggccggacccaccgggatggtcaaagacggatcaggtgtgcttacggaccttcctaagaataaggacgggaacgcagtccaccccggaagggccgaggctctatcgcagtggaaaaggtacaacaaagtgtggtcacagtggtggaccgcggcacgggtcttggacggtgcacttgcgaaccccttccaaatgttcccacagtcctttacatttgcccgaaggattattgacccgcagtatgaccacgcacagtggacatacttcctccccatactctgcatctcggtggacggggagcctgtcccctaccagggacaggaaggtgtcaatcttgcaacgggcggccttatgtggttctggccccagatgatagtcatgatgtctgcgcttctttcggccataaactcatcggggaaggtctacagtgtcgaggatttaaatgcgatcgcaactcaaactcccgagataatatcagaggcaaaacagacgatcgtgatgataagaaatcacctcaccaagattctgaacatgaagaccgcaaaaaggactgcgaagtatgcagaagtagttgcagatttcaaaacgagaatattggaggtacaatacagggccgataaagcgcgtgatgcgtacaggctcgtccaaaaagaaatgtctgaccttcttgtcgaaagggacgaacagctcgcaatcaatgacggaaattacgagcgtaagaaggtaagtctcgaagatcaaatggccatgttcggtctgcaagatcttcccctcgctgcgaaggccgcgcaaaagagggctccgactctggcaccaaggccggcgttggaagaggagtcagacatgaatacggctctccaggaccttctggatggtaaataggattggcgctctggacatgattggggggaggatgacctgtacgacgacgtggagactagcgtgtccggatatacggatcgctctagtaggagtggggaatgggcgtatacgctcaacaagatcacccgccctccacccgtcaagggcattaggtgtttgggatggtccgggaaacttaaatacatgtacatggaaccaactactgcgaggtcttctctattccaagaattcttctcgaagcatgagggtgggggggtgctctggggtgaaataccagattcaagttgggtgaaggaattccgaccgcccagcgtgtctgaccttgaacgtcatctggaacggtttggtggggaaaggaatgtcaggtatgatgtgataaagaggaaccttccgctggctctaagccgaatgaatggcgcagaaggaaccacccgtcagatcctactgacagactggctaaacctacacaatctattccgcgttaaggttccgtctggcacgagtgccggacttagatggaagaaaatggggttcaagaccaagagctccgctctgcctaatgctcttgaggaggcaggaagggatctcggtgctttaagggagggaaggctgtacgaaacgcccccgtgttttatggcagccagagggaagctggtcgacacttttaaggaccgtagcaagaaggaaggaagactcgtcgtggtgcccgacctcaagcgccatctaatgggatcgttggcatccgttccttactctttacttgtcaagaacttcaacaaggacaaggggggggtaatgatcggaatgtccaattttcatggatggtatgactacttgagggagtgcattgttggcgaaagaaaaccaaaattcttcatttgtgcggacttctcgggatacgatcagacagtgccgagggaaataatctatcacagcctcaagagaatcgcgcgcaggttcactccagatcctgggcatgacgcgtactggaaaagtgagtttaagcatctcgtcgacaccctcattgctgccccagatggtaatctctatgttaaagagaggggggtggccagtggggatccctggacgtcacaggtgggtagtgacgccaactggctcatgcatgaaatactctttggggaacttaagctcgacgcagcagcgtggacatttggggatgacgtggtagttgctgtgtacgacaccccgtatactagggaagaaacgctacagctatacactgataagtttttggaattctttggactcgaggtaaaggcgtccgacacatatatgacgaattttctcgagctttcgagcgatcatccaacaccagggatgagcgttaagttcctgtccaactacttcatacgcacggagtatggcgttatgcctgcgccagacttcgtgtccactgtcgaaaacatgctctatccagagcataatcccgaaacccaagacccatgtccgacacaagacgatgttgttctttgggaacttgcaaggtgcactagctgttaccttgtaggatattggaatagggacgtcagaactatgatggagatgtacgcgaactggctgcggacgaagatccccgacagcactcgattcgaaccaacgtactgggccaacgcgatgaaggcctgggatgttccagcttatatcatctcctcaaggtggctcggcagtatgccgccttttgtcgaggtcctctcactatataaacaaagcaccggggagggaaggtttcacgccgcggcttatgaaacgcgacttctgcaattgtcgcgtgacatgccaccacgcgtaagggatggataacatgtccagggcgtaagaccaataggagtgtaagtcgttaaactagcctccactgctgaccaatcgggccaatgtcattaaactgtgctcgcaagaatcgtaccccccctcgcgtccgacatctttcgcgtgcaacgaatccgtgcctgcccttaccccaactcgttgggataggggtgggcgagacggatgcgtaacgggccattgggactgcaccggtcaccgggtgcgggaggaccaactgcccgcagggctttatagggaagaagaccagaccggagtcggcgttctcggacgtccgttaccggaatggcgccctgagcacgcgacgtaaaagttaggcaacggaggggaggaagcgaaataccttgatgcgtcaccagagatctgcgatatctggatggttaccgggacttgttccaggctagacgtacggccc

SEQ ID NO: 479 - DNA, 1498 bp, Unknown
  derived from dsRNAs of unknown virus
gaatattttgagagacacatacacataaaaatttgaagatatgaaattcaatattaatgaagaacaggatgatgatacggctttcgaagaagtacttaatgacgtaattgaggcagctgaagatgtaattgataatgaccctgaagagactgcccgtgatcgcttggcggacaagggcctcgactatatctacaagggtgttaaaaatattaaagattgcattaataatccacttgagtcgcgtcttgaagatgttggtattagcgccctacgatacgtagttagttcataccacgcacgagattcaggactagaacagtcacttcgtgataagtctgatgagagaattcttgcctcacaacaccaggattcactaatgaataagctatcaactgaacaaacagagctaatctctagtcgtgcgcaattacatggattggagggcgcattacgtgacatatctaacggtcctgacgatgatattacgaaaatgcctaaactaagatctttaatgtcagaaattgagacgtataaatcaatgattcaagctagtgaagagcaggtagctaaatatatggtttcgctaccaagagcgcaggcagattacgacgccgtgctgcgtgatgttgatgaactactcgaaatgaaatcgagggtattgtatggcccagaggtaatgcttctatgtgcgccaaactatgtaattgacactgatgacgacttgccgtacatcactgccagaatcagtgatgaaattgagaatgggattgtgccggaattaaaagagcaactgaacaagattaagctctctaaaaatgataatggagctatggagcttgcgttattctcggcaacatcatctttaacacaaccattaaaaactcatggagaggaaggtaacttactaaatggacccctgatttcaagttataacttctttaagaattcagaagtcggaaaggtgatacataacattaatgttaattcgttgttcatgcaagagttcagaggagagaaatttaaatttgatccagcacgacagaatgaaatcataatgaacgacccaatcaaatcattagacacaacattaatgaacgaaatgtattttctaaatttaacgtgtatgtctggctatgatcccatcacctgggcacggtgttttggagtaccaattagtggagttggaaaacaaatactgaagggatggagaaatggcggtaagatacctctgaatgctgacaagctgaggaaaatattcctagagggtgatgttagtaaagaacacaacttgctactagacgtcaacaaacttgactacgctgaatcgttcaaagataaaatgagcgagaagattctagcgctgaaaaatactgacttgctaactgagcaagttaaaaacaagcttgaatttgaaaagacgtttgacaagctgaagaagtctagtggtgaggtgcaatttgtctaacatttcgttacttttcctctcaaatgaaacatc

SEQ ID NO: 480 - DNA, 3147 bp, Unknown
  derived from dsRNAs of unknown virus
cgcgttcaacggaacgtaagctcacgagcgaaacttcagctagccgcaatggcgacatggaagattccgcttgagctgctgactctgagtgagggaagtgtccccaccctggcctcttcattgatggcaggaagtgcttttcgctcagatgggacagaggtccacccaagcaagcaagtctaccaacaaattggtgagcacttggatcgtgcgaacacagcatggcgtgttacagcaatggctattgcgacgatccacccatccctcgtccggggagtgccatactccggggagaatagagagatggtcgacggattgatgaatctgtacatctggtacttcaggacctatgtccgagctggttacagagtacttatcgatgccgtcaagtgtctgaagaactggagtcttcactacagtcttcgagacaagtcgagtgcgccagagctcatcccgagtctcataggagctaaggatggcactctgacatttccttggtccagaggtcccctatctagcaagattagggtccctcagtactacacgcatgatgatcagaactctcatgcgctctttcagctgtaccttatgggaaaggcacttgatctccctgaagctgataaagtagtaccgacaattcgcaagcacttcgaggattaccgggccgcgcccggaccctctatactgtacgaattggccaaggactggtcgaagaagtgggggctccattgcatggagcttcggggctcgaaagagttcactctaagcacccacttcggggctggatcctccttgacctctccgaggtcgactggagggaaggacaatgatgcctttacggtagtcttaccgtacctgtcaaacgccatcgaagttcatggcgattatgaggccttttcattgttcggagagaagaagatcgacgcgcgacttctcctccaagctccgctgattcctgggacgtcactacgccgtttcccggttcggtggctctacctgagccccgaggacctcgcccaaggggtccagaatcagattctcatcgctagggatctggcgctgagtagagtcatgtccagagggtacataactatcggagattatacgggcatgatcggttcatgtccgtttctcggaactttcatgtccgcaaaggcgtggaatggaagatccgaggacgaagggccgttgagtctcttaatcagcagattggttgagatcacggtagtcctagagcggggtgacaaggcacgccctgtgaatatctcagactgggagttcactgttctaggccacttcgtcagggattacctctaccaagcgacagaagtcgatttggaaatcccgaccctttccggtgcgtccggagcggggccatttatggcacgagttgttgcacagttgtgctctgacttcgaagtcagaaacagggacctgctccctgttgctgtgcaagcctggctccagaaactcgaactcctatcattggatctgagccgttgctctgacaagatccttgggagcttgtcaagagggtttctcgaagggttctacattggaaccggagcccacaactcgaaagccttgcaggttctctttatgctgaacaactcagcgagaactattcgttatcgcgatgatgcctcactcgagattacatctgagtatgggccacccatgatgggtgatccgcccacgtggtggatagataacgcgtatacgaagtttgcaagcatgcttgcgcgagagcttgtgaagatcggggtcgacccgtctacactgaagaatcctgatgaactcgcagcgtggctgcaagttaacgagttccatccagaatgggatttctcaccatcaacccgcatcaggtgcggtgacgatgagatagctctcgatactccagtcaataacatggcggtcatcgacatctacccttccctgggggggttggtctcgcaagggacaaattgtcgctctgagagttatggagttttctgcgagtcggaacttggcctgggtgattgctcatccgccagccgagtacttcgatggattgacatcatgagaattaaatccttgtcgaagccgagcgcaccacgtcaaacggaggaagcagaggctccccccttgtggacacgcggtcgagctgcctcttctgcaatagagtggttcagccgatcctcgccggaatacgaactcgcctcggacgtgatccgaatagagatgttcgaccagatcgaacggtcgtattcaatcggtattcagtgctacatatcacccatccttggcggattggggtacccatgctcgtatgcacacgcctgggacagggcgaaccgattaactcgtgatctgctagagggtatagcaaactacgaacccgccgagttgaacctacctttggttcaactacttgcagagcagtcggcgctgtttacaatgcgggtaggcgggaatccttgggcgatccaggatcgacataccatgtcaactatcatggaggagctaattattcgcgacgggttagcaacccgattggatttagcacaggcctccggcgtggatgtcgcctcgttccctgccaccttcttttctaagtatagaaaaccgttcaagccgccaggcttggagacacggtggctaactttcccactggccttcaaggaagcccagaaccggattattgcaaaccgggggattgttcctcccgatcgcagagtcttcattgattcagaccgcgatatgggaatccgttactccgagggtgctgtaagcatcctgaagatcttggcagatcttcgccccacagtgctgcgggggagcggagttttcggcggggacctcgtaaaagcagcagaggctgcagccgacgaggccacgaagcgcgtcttcgtaaacatggacatactggagtccgtgttgcccgataaggtcattcgaatggccgtcagactgtagaagctgacgcctgaccttactctgaagagtccctatggatgggacataggagtgtctactcctctaggcctcccgaaccgcgttatgtaagtcaagcacgtgtactcgcagcagtactaagggcagcggttgctccctgttcctactgcttcgacctgcaggatctttttccggcgcgtggggaggccgcca

SEQ ID NO: 481 - DNA, 782 bp, Unknown
  derived from dsRNAs of unknown virus
gaagaaacatgcgaaggattgatcctttgactgatgagtggaccagatttagacgattggaggcgcagagaagaacatatatccaaaatagatgacagtgtaaaacatggtcatttcgcctataagaagagatacgagcgagcgcgaaaacagttgtcgtactataaagtacccattatcgttttatcgagtgttaattcggtgttttcggtgggtgctgagcgctatttcgagcgacatgttatagcagcagtaacgtgcatattagcactaactgttggtgtggtacaagcattacaaatattctttcaggtagatgagcgtcgtgagaattacctcacgacgtgtagagacatgcgccgcttgcatctcaagataatgggtacattaaatcttgagagaccgcagcgcgcctgttcggccgataaatttatggctgaaatacaggctgagtaccttgaaattattgataaagcggttgtaatacacacgcgaaagagggacccaatgttcgggagattaactatgtcagcagctggtgaattagatttgccagcgttatccacgtcagaacgtagttatgatgtgccagaaccgtttgagtctagttcagctgatagttcataacaggcgcgggcctgattatgggatcaattatagtaacgccacgttaaggtgtgagacccctccaaagggcaggaacggctaaccataaatcatcaccactattcactttcgcatcgccacgtggggcgaaccgtatagggtagtttgtcatagtc

SEQ ID NO: 482 - DNA, 2536 bp, Unknown
  derived from dsRNAs of unknown virus
aagtgccagtcaaacaattttatacgtaaggcatagtgtgttttgaggtgccaaaatatagtgagtccaatggattcattggcccccagcacattactgttaccgataacaagtggtccgtccagaggacgtactcttgtcgtgttaccagagcctgaagtacaaattcgcgactcactactaaatgtatctctagtattcgatgactcaaagatacaagaaagtgatagtgtccaaaagcgagatgaaaggctaatggacatattactttccgctttaaattcttctgaattctcaagcacctacttcaatcagttggtggaaatcttgcgagacagaagcttgtttagcgaacttgataaagcgcttggtgatagggtgggtgtcctaacagtgtcacgttccggcggaacatatgtggcgcaaactgttggagacagtctgccactcacagacgctcgacgttttatcatccgtgcccggagacgtcacgataatgtgattgaaggagtacgaaccagtgaagcggtatccattgaaacagacatgaatggtaagaaattcacttatttaacgctgagtggagcaagaatgccaattgtggttgattcacgcagtgaagcactatcgttacgtgatagtgatacgctcggtaagatggatgtattatgcgacttctcaagacatgttgataaagatgtgccatttcatacctacgatgttggtgaaggcgtggaccactctacatcagcggaaaattctggtgagtactacaataaacaacctataaagatcaagctgtttaaaaactatgggaataacacgggtctattgttgcagtatgcaccacatgccgcaactcgcatgaaggattatggatttggaaatggtgaaacattaatgttaaccgagcaagactttgacgccttaatatcagggggacgttccgtacctaatgttaagatggaaaggttcacaaccaggaacagaaaggcaaagggcgtgtcaacacgcttaaccctggaagtaccaaatgtgcacgtgtcacacaacggcgtcgactatgttgtaactttaatacttggtgttttatcaagcgtgatgcatgatgatgagataatcacggtcgagtcttttgtaaacttgaacaagaggttagaactaaaggaaaatctcgtgaaactaattacggtgatacctacagtcataggtagaaaccgattcacaattactacaacaggcgtccctgttataccatcacatttggacttcggtgacattgaacatccggtaaatataattccaaatgtacccacgagcgctgagaatagaaaacaggctgcggcagcgtacgcaaccgtgctatcctctggtgatcaatggctcaacatacattcatcagagatacgtaagtactgctcagaaccgctacgtcgttccttgctgcaacacctcaattcatcatcatacgcccagataacaaaagctggagtggaatttgaggatgttgagtatataagaactcaccgtaaaggcctattcaatgaacttttgaagttaggccaccatatcttcaaggtacagtggttacgcgatgtcagtgttgaagagatttctgaattttggaatgaatattttgaaaagcattcaaccccaagtattgtgcattcgggggaaattcgatcacccagtgaggtcctaaatggaacaaaacctatagacgctcctctactactcgtaagagtcacactatccttactattaattgtcggtttgtcaaagaacatgaaaaagcacaaccccacaaatattaacatgcgaccagatattcatcaccttttgagcgagaaacgagcaaaactttcccttatacctttatgtgtgcttaaaagcaggctccttgcatacgaagtatcaggttcagttgggcgcttgttaaataatgtcgcagatgaagcgttaggtaaatctatattaacgtctactaaggataggagtagagttaaacttgatgacgagcgggtcgtgctaaatatggaggatgcagcttcagcaatgccattcgaaattaacgcaccagtaatcaaggtgaatgactctgagcgagcatcacgacgcggttttactgtggttacgccgtcaggtgttgagctagacgtgtatccgatctgcgagagtatgtgtgcgcgcttacgttcctatcatcatgtactggaacgtaatcgtgtcgcaatattctggcatccaattttctgcatcattgcaagcgcaactgtcgttaagccacatcctgatgttgaagcgaaaagtcgctaccgatgcataatcttgccgtcactaagaccatcaactatggctccctcatatcataatacccgtgacagtattagattgagtaactatggtgatgactccacaactcattatggcgtgttgaaggagatgattggttacatatcaagctttgcaacgtacgcaagcatgtacttatgacccgactgttttagaatattggtccacacacttcagaaacatc

SEQ ID NO: 483 - DNA, 1919 bp, Unknown
  derived from dsRNAs of unknown virus
gtgaattatgatcacaactttttgaattagtcattcaaaataagccaaaaacatatatttaataataacttactatatgaaatattcgcgtaaaacaacacgaatggcagcttttctgcctggagcaggaggcttcgccagtaagatcgcaggttctgcaattcgtaagaccgctgcggcttacggccaaggagcagatcctagaacagcagcagagattggtacaacgggcgcagtgttcgaaaacttaccgcctggcatgaaaccgttcctagatgtccctggcaaccaaatctcgaactctgggaaaccagatccaaataatgaacctaaggaggaaactagcatgaagaagggcaatggaaacggcaacagaaaaaccactacaggcacaacccctccaccaagtggcggcgggaacaatcgaaacagacgacgtcgaagaggagacgacgactacacccctagtacaacgggaagttcgattaaatcctatggtgctggctatggcattacagatagcggttctttagtcaatgagcaatactcgaagtttggtggcgctttttacaatccattgtatgtacaggacgtcgaggaagatcgaggtccactaaatcagaataccgtccgaacggcaatccgagtgattagttgttatcccacaaatttgttacaaacagatttgccaactgctgatccatttagaactacatttcttaattctaactccgaatcgatttccagtatagaacgaatttatgctgaagtcaagatgcaagttaactccaacgtcggcggtggaacagctgcatcaaagaacagccttacatttaacaaatacttagagtttatccgcttaggtatgtcagggttagccctgctttgtcaaattaatgcaatccagtcttgggatccagactacctggaatcgaatcttgttatccgcgagatgaaggaccaagctgcaaacagtatcaatttgtacgcggctagaaatagattaatgaacaagttagtctacttaagcttgcctccaaaagtaattaattactatttggaattattccaattctataagaaaacacccgtggaaggtggtggacatcagttccatatcttggaatctttagcaatcgatttgagctcaacaacagatacggattttgccactatcattagtgaagtaaattctatttgtgccgaaatcgacgcgactcccggtttagacgatctagctaccatctcagcattactagttgagaaagcagattaccagtttatcaatcttcgtcgagttcaaggtatgtacaacaaaccttgtttcaatcctcgaatgaatggagttctggacaactgtccaacttctactgaatcgaagaagaaacttggagaaacaattgttacgaacggtggtttagcattcacggaagacgcaatctgcgcctatccgatggacccggaaaatgtctcaatttatgaagcagcgcatacattaccgttgtgggatcaagtgcagtataactctgaaacaggtgcgttctcgcataacaaaactgcctttccattcttccaatacgtctatgagttgacaggaagtgtacaacacaacaacacaggatacttagccgtatcaactaaattaggggatgtacttaaaccctatgggctaggttttactatcatttccgatcctcaaactcacattacaaaccacatcaccagtgtctctacacttctacttaatggagaagttaactcgttggcagtgccaaaaggtgataacaactacttatacaatttctcgcacagaaatgttcttaatgcgaacgtgcgtttaatttatgatctatttggtgtacaaatcttctagatcaggataataataccttcgggtaggatgggtgtaaacccatctc

SEQ ID NO: 484 - DNA, 1314 bp, Unknown
  derived from dsRNAs of unknown virus
gaataatttagtgcaactataagagttcgtgtgtacaatggaaggaaattcactgttcaaggagcaagatctatccaagttggcaatcttaagcgtcgctcaaaatgtcgacgccttgaatacagttcaaaagtttgaagctttgttatctggatattcaggcatttctcagaaggaaaaagatgcgatgattcatcgtgttgccggatgtctagatgctgaaacggatcgagatgagttgtggaagaagcgtctgagcgagcttcttgcacagagggaactgctaattgaagatttcgatgcggatcgcacagcaacaattaaccaatttaggcgcaaggcagctgaatatggaatcgaaacagataacgatttcgtagaattcaagaagatgccaggaagtgcattcgcgagtgtcgagcaattcgattctaaggccgatgatctagcgatggagctacgatcacgtctgaagcccgtcactctcgcacacaccagaaagttggcagagaaagacaacatgattagcttacacaatcgtcgtcgtggtgagcaattctttgaggcgggtagtgctgccaatctcataagaaaggagttggatgagccacgaaatgatgagagtgtactccctccgaagggcgagaaggaatgcgagaagatggtggacgtgctgcgcaaaaagacgggtggcgcccaggacgctaatcctctgattcccctcaccaatgtacgcggtgagccgactatgcagatgcagctagtatcgattctatacggattatcgctggctggcgttcaagtgcagagttattatcaaagcctagtgctactaaaccgcgtgcgtcaaggattctcgaacatgtatgaggggattgatattggacagaagttcatgaacagtgaagtcatcaaagaaattgaacatgcaaatgctcttatagcagctggattctcaccccttcgttggcgtgcggcatttcagaaaccaattcgcgggatggtggaacaaatgttgagcgaatgggagagaagcggatacaagacgctcactctgccacagttgcattctttattcctggccccagtcggctcgagtcaggcggtgactattgtcatcccggatgagcagcgagaggagagagataaggctggaaagtctaaggaagataaggtacttgaaattctgaagatggttattaaaccgacagaaaacgaagaacttgaagctcttttggtagaggaagatgagaatgcaatgctttaataaagtgatattgagcatctttatcgtcagcactagacggaaacatc

SEQ ID NO: 485 - DNA, 965 bp, Unknown; identical to SEQ ID NO: 340
  derived from dsRNAs of unknown virus

SEQ ID NO: 486 - DNA, 1397 bp, Unknown
  derived from dsRNAs of unknown virus
cgtcaagaagacgtacaaactctaactgcggaacaacgtaagttcaaaggaaagtatgagtggtggtgcaccaaacactgcctccagcgcatctgcctcctcgggtaacgccagcatcaacgtcagccccgccgctgaaatgctcaacactctcgtcgcacgcaacttaacggcgagcgagatgcttgtgcactcgtccttcacgaaaggcatcatggctctcaccagaaacggtttgaccgaacacgccatccacaccgcaatccgcgagatcatcacgaacgatcgttctcgcatcgcccagcgcgtgaccatgcccaacgacaagggcggtcgcggtgtcaacctgtcattcccagcggcatgcagcatctcgatgttcatgaacctggacacgaagcacggaagcgggctcgttgctgccttcaccgccctggccgtcgagtggggcatcatcaacgaaggtgccgaactcgctcaagacgacctccgtcggatgcgggctgccaacgagaacgccatgtacgacgccatggtcgcccaggccgatgcgtacaacgctaccgcccaagccgtcaagttcaacgtcactcgcatctccgttgccgatggagagaccatggcatctgagctcgacgccatctcagcgcaataccatcaattgccaggcagtgtccactcggccacagtcaaccacaggatcgaaaagtgccctgtcaccggccagcaggtgtacatcgcctacatcggtccgctcgaagccacccaccgcaacctcaaggtggccaagaagaaagtgaaaatcgcctatcacaattcaagccttggacagagcactgcaggtgactaacgccaaaactcatatctactagctaccgctgccacgcgacacagcagcgttagcgtgaacaggattcgatacacataagtctgacactatccacacgtctcgtctgtgtgtgtgcgtcccgactagtagtccacaaggtgtcatgacgccactgcagggcaacgagcaatccgtgccgcgcgatttaattcaaataaatcacgtttccacggagccaaccgcccctgtgtagcgccatagtacaccatgaactgccagttgtgactcatacacctagactcgtcgtcactggatggcatgtcgacatgttcggccacggcacgaccgaacactgtccacacgccttaatgcttgccaaccttctgactcgtctcttgtctttctcttctacattctctattcccgaccacaaaatttaaaacgcggcgagctcgtgcactgctgtttgacattcgtatgcccttgcatgcgagtgccacgctaatttcagcacccacgagcaagcgcaccgcaccatgcgtcccgcaccttcgaaagaaggcccccc

SEQ ID NO: 487 - DNA, 909 bp, Unknown
  derived from dsRNAs of unknown virus
gaatattgaataacgaaagtgaacgaactgccgattttaattataaatcaaatcaaactatgacggacgcaaattccctaaaagataatatcgaccgcgttagaaaatggaaggctgaagaatataccgatgcctcatctatcgcaacaggaatcgaacgcgctcgggccgtaatatccaaccttttgagtgggatcacacccgagaacgtagaggggttaacgtgggccgtaggtgagattggaactacgataacagaagtgcgaaaagcagtaatgcagtgctcaatataccaggcttcatccgccggtgagcataccgcgatggcaataatatctgatgatattttcacagctctatggcaactgaacaacgacttactcaacgagcgattaaaaatgctggatacacgcaggcattacatgcgcagacgtgaaaccagaaacgttgtatgtgctgcggtggaagcgtctttcatgtttacaatgtttctagcaaattatgaagtattagttaacgccacatcagatgttgtacgtggtgccgcgaactggcaccaccacatggcattaatgtttgatcagctatctgccgcacaaacatacgatccagagatgttgaatgaaggtgaagaagccctgcaagcaccatcagacattgaacttgatgatatgcctaacttaataaccataaactcagaagaaaccgatccacttagtgacatcgaagaacttgaagtcacaagtgaattgagtgattctagccaaggaacaagagctcagacagttaatgagattgtaactgaacttacaaaagttaagagtccaattgacgtataatagtgattttgatgtatttctattccaggggtgttgcccaacttgtcaatttcgttatacatgtaacatc

SEQ ID NO: 488 - DNA, 1557 bp, Unknown
  derived from dsRNAs of unknown virus
gaatattattgtacattgtaaaactgttaagaggaaaatgggtcgaaatctagtaaagcgttcaattactgatggagggacaaagtactcaaccagagattcaagtggagtcgttcactcagcaccgacggcaggcagattatcatcaaacgtcgtcaaggaggagaagcggaagatagaagagagaataaggcttgagaaattgaggcttgaagcaaaaagacgtgaagaagaaaggcttgaggcggaaaggctcgaaagaaagagacttgaagaagcggagcttgaggcggaaaggctcgaaaaagagaggctcgaagaagaggaaaggctcgaaaaagagaggctcgaaaaagagaggcttgagaaggaagaacgtgaatcagaagaagccaatgatagagaacgagaaatcgacaaagataacttcaacaaagatatcaacaacgcagatccgccacctgaagagggggatggaggctcgtcttcagataaatggaacccgttcagcaaggcttccctggagggaataaatgacctacatctggatctattctctggtggtggagctacaaacttccaagacgccatgacatattacgagggcatagtttacaaactcggtggcgtactttctctacccggtatgccaacagcgcctgcagcgcaccttgcaatgcttggggcggatctttcacatgaattacgaacagcaagtgcagatgactggaacccaactacagataatcgaacggaagatgaaaagaacttcaatactcgactaggtgatagaatcctacgtaccatggatgtggtcggtgcattactagacggaacgccacaagaaattgcaggaattcctggcttcgacaaggtctcacaagatgatgacaatgaagatttctttggtggtgtcggaaagagatttgaaacacttggaaataaatctttagaaaagttaatgaaaagcaagacagctaaaaatattgtattcggatttgattcgggtatatttaacgcactatcaaagtttgaaactgagtcacaaagaataagaagcctacacggcattcgcgtaatagaaagcgatcgatattatagtgtgatgtatcatccatctagtggaataacatatgtagagtggaatcccacgacagacgtgcgtaacgtgatacgtcgcgataagcgatcagatgttggacgtgagtggagtgaagacttcattgctgccttaggtatgaaaatacctgcatggtcaaagcgtgtgaagtacataaaggagaaatacggaatggaaagcgatacaacaaagcattatggatattcccgcggaggtggcttggccactcatctaggtggagttggttatggtaccggttacttttcctcttacctaccacatagagcttctaagtcgaaactaagtggagataaaatgcatgacttgataatcaatccattatcttatgctatgatgctgaggaatataactcgtacatgaaaaatatggacaatgtattctagctacattgaattatggaccacttatgaaacatc

SEQ ID NO: 489 - DNA, 1596 bp, Unknown; identical to SEQ ID NO: 387
  derived from dsRNAs of unknown virus

SEQ ID NO: 490 - DNA, 909 bp, Unknown
  derived from dsRNAs of unknown virus
gaatattgaataacgaaagtgaacgaactgccgattttaattataagtcaagtcaaattatgacggccacaaattccctaaatgattacgttgaacgtgttagaaaatggaaagctgaggagtataccgacgcatccactatcgcgacaggaatcgaacgcgctcgaggtgtaatatccgacctaatgagtggggtcacgcccgagaacgttgaggggttaacgtgggccgttggtgaaattggaactactgtgaccgaagtacgtaaagccgtgatgcagtgttctatctaccaagccgcttctgctactgagcatgcggctatggcagtgatatcagatgagattttcacagcgctatggcatttaaacaacgatttactaagtgagcgactcaaaatgcttgatacacgtagaatgtacatgcgtaggcgtgaaactcgtaatatcaccagcgccgctgtagagacgtcattcatgtttacgatgttcctaacgaactacgaagtgcttgttaacgcaactagtgatgtagtgcgaggcgctgcaaactggcatcatcacatggcattaatgttcgatcaattgaccgcagcgcagcaatatgatccggaaatgctagatgaaggtgacggaattttccctgctccattagatattgataatgatgatatgccaaaactggaaaccattcaatccgatgaaactgatcctttaactgagtttgatgatgttgaggtgactagtgaattgagtgattcaagcaacgggattagggcgcaaaccgtaaacgagatagtaaccgaactaacgaaagttaaaagtccaattgacgtataatagaatttgatacacattttaattccaggggtgtctcccaacttgtcacttacgttatacatgtaacatc

SEQ ID NO: 491 - DNA, 1076 bp, Unknown
  derived from dsRNAs of unknown virus
ggtttaaaaataacttctttttgaagttgagcacaacgcgatggcacatctaatccaaggagctgtgaacacagttttcagagtcccggcagccctaaataacgaagttccttatgactggttgatggtagcacacgggtatgcagttaatgcggtagatttttatcagtatgattccgctgtacgcaatggcaattctggacagttaccactacgtgatgcagcgctacggaagctggtgagtgcgtcggacgtagacatgacgaatgcatgcgaacgattcatcggaatgttacgacgtttgttggcgagtgcgaacgctccgaataatttctcgcgacgtgagctggatattttgaatgaaataggcagaaccgtgagacgtcctaccactaggccactgattatcggtgcgattgatgagttcgtgcagggcaacaaccgacctgcgataacccacaaccactgtcaagatcatgttacatcgattccgggtattcaagctggcgcccatcccatgacgtatattcaaacgcgcgtacctacgacgttcttcagtacaaattgttcattcgacaataacgatcaaagttacagcgctcgcactggaagagtgaatgtatcaccaatagctgctgaggctaaccgaatttattacatccattcgactgctatggtggacatatcttctacggtccgtgaggcgcttgtgtccgctggagtaagatattgtatcgcaaacagcgttgaaccatacaatagagcaccgttaccactttggttgatagttcaacaacgattgcaagcgtattgggtggctggtccagcagcgacgtatactcgtttgatgacagcgattcagtttgaattggacgtattaatggctatcggggttatgagtctgagcagattgtgttgattgcaacaccatctgcctacgttatcttcttggaagcgttgtgccgtatggggggtgtggtgacgcacagggggttttctcctgaccccctccacatctcgctatcgtagattataagctcggcacctccatgttgaggaggtggtattttctgacc

SEQ ID NO: 492 - DNA, 901 bp, Unknown
  derived from dsRNAs of unknown virus
gaatattgaataacgaaagtgaacgaactgccgattttaattataaaccaaaacaaaactatgacggacgcaaattccctaaaagataacatcgaacgcgtaaggaaatggaaagctgaagaatatactgatgcttcatctatcgcaactggtatcgaacgtgctcgaagcgtaatatccaacctgatgagtgggatcacgcccgaggatgtagaggggctaacgtgggccgtaggcgaaataggaactacagtaactgaagtaagaaaggctgtgatgcaatgttccatttaccaggcttcctcagctactgaacatgcggcaatggccataatatctgacgacatcttcacggctctttggggtcttaacaacgacctacttaatgagcgtctgaagatgttggatacacgcaggcattacatgcgtagacgtgaaacacgaaacgttgtctgcgccgctgtcgaaacgtcatttatgtttacgatgtttctcactaactatgaagtgttagttaacgcaacgggtgatgtagtacgtggcgccgctaactggcatcatcatatggctttaatgtttgaccagctgtctgctgcacagcaatatgatcctgaaatgctgaacgagaatggcgacgtatcagacgtgccagctgaaattgagcttgaggacatgccgagattagaaactgtatcttcagatataaccaaccctctaactgaaattgaggagcttgaagtgacaagcgaatcaagtgagggtactagggcccagacggtcaatgaaattgtagctgaacttacgaagactaaaagcccgattgacgtataatagtgattttgatgcattttaattccaggggtgttgcccaacttgtcacttttgttatacatgtaacatc

SEQ ID NO: 493 - DNA, 1925 bp, Unknown
  derived from dsRNAs of unknown virus
gttttaaatataacaaatacgccgagaggcattaagctcttatagagaatatttagttgaaatccatatctgacggaaaacagatcaaccgtcgtaaggacgaaaccaacaactaactaaccaaattaaacaaaatattatggttaacaactggacaaacaaacccttgaaaaacttagggtctggaattgaacaagccggtagccgtttaggtagtaccgcaggtgaatttatcactgggacatcgttgcctggtgaaagcaacccactattaaacccaattatgcaaatgggaaaaggtgttgcagcaggtgcggcagagaacttgattaatcaaggagccgaccgtttatccaataggattaagaatataaacgaaaaaggtaatatgaagaataattacaaaggcaaaggaaaaccgaaatctaacaatagatcgaagaataattcgagcagaagaaacggatctaataataacggatccggtgcattcggcccaagatttaactctaatcatggcggtggtggaggtgaaccttcaaaatatggttactctggtagaaccagcgactcatcaaactatgctccgtttaatttaggacctgtaggtgatcctaaactcgggggatacatgaaagtcggaactccatattgtaacaagtttcactcgcagttcatccataccggatcaatacatgataacgctaattacctccgtaacacgtttacattgataaacttagattacgaccaactattctgcacctctaatagtgacaattataatataagtccaattgacacggccctttacaaaattgtaaatcagtacagaatggcaatcctttctggaactggaggaagtaaggccgctgactcagtcacgatggaatcgatgactttatacttccaatatacccagtcattacttgcatacatgatagcgttgactgctatcatcaactgggacccaccttacgcggaacagaattctgtttttcgaaaattgcagattatctattccaataatgtggagttacgtaaaacaatggcagaagctcaagacttactacaccaatactgtcttccacgtggtgtaattgagtattacagacgcctctttactgtaacaaaaataagtagtttagagggtggcgtgcatcatatgttcattcctgaatgtttcattagtgcacttcaagccacagataatgacttatctgtcgttatcaatactttaaacagcttagtcagtgcaatcaaaacgaatagtctaactagtactaatgactttccccgcattactacgttattgttagacaaaacccctttcgacttcgtttcattacgaacagcgatccctatgccggatcgtcctattcgagacatcaaccagatcactctcattaacaatggagcttggtctgcgtcaccagctgtaatcacaacggacaagacgacggaattttacgtggaaattacccgtatagctctagtgattctcgaatgatctcaataatggagccagatgaaatagagacttatgaatacgcacccctaattggtgtattccatgacgaacatcatcttttcccaatgtggaattatagtaaggttatcacaacgttttctaatcgcatttaccttcaagaaaatccaaacaacacgacttatggaatggatgtattaccaattcttttcgcatacgaagatcctcttgacttcattgcggtaacgcgaactatgcacgtttcaccaaccggcgagcacactgcaaaagtgtacaattcagctagaggagagaatgttagactatttgatctaacaatcgagcctgtaattgaagcgaacgttaacttattgaatcagttatatgatgtaagacaagtttaacatagcaggggttattcgttagaataactcct

SEQ ID NO: 494 - DNA, 7540 bp, Unknown
  derived from dsRNAs of unknown virus
cataaaataaaatcaactttagcaactatggggaggaaaagttgattttatcgtactgatcaggtgaataaccagaactatcaacataatcgatgttgtcgctgcagcacagcggaaccaaattaaatgtctagtgaaggccgttttactcatggcgtaacacttcaaaaatcaccatcattatacggaagtaccggcaatgataggttacaaaattttgaggcccagcctcgtggtttttgccgaccaggtttcacttttaattaaaaggccgaaggagcaagaaaaatacaatgagttccataatgtgtaagtcattcccctgcacgggagccaaggaggtaaagccttggactgacagttcaacagtaattgaacacgagcctttggctcaaccccataacaacgacaaacttagtagatattgcatcacagatccgaatggtccagtggtggacattttatgttgcaatattgaatgcaccttatccgggcggaagaatgttttacacattcaaccacaggtaggatctattgtgtcacttcgatgcatgttcaagctatttgaacatttcaggatcggagctgacacacacttatatgatgatgacaggtttgctgacgcggaagacgatccaacagctgatatcgctcaattacttggcgagttaaccataaatcaatcagacgctgattcgcaaattcccattgctgacggtattaaaccagaccagaatatgatctcagaatttaaattcgatgataattacattaatggattgtgttatttgcatctgctgccgttacagttgcggccgcaagccagctctcagttaggaatgtaccctacagtttcagagtttgccaaatttacttttgacaacctgaagaataagaaatataaattgtactgcgaaatcgacaccacattgcattacaatggtaaggcagggtatcatgttgataagcgagctaatacgtccgatgaaggattgttagcaacacttgagtcacttgagcaggactgggttattggtggtagtgaaaccgtttcagaattaagttcggtgatactcgctagaactagcatgtacgcagcaacaaaacctataccaaaaaccatcatgaccgtatcagtaaacttcgctaaacctggagaaggttactgctaccttaagttctttagaaaggatcatagagagaatgcagcaaagtcattaatgtcttggccgaaatctcatatggtttatgcaaaactcatagagcttggtgtgtcagtgacaaccggtgtgaagttcaagctagctccagttggttttaactcctatcatttggaggatgcagaagatcaagttaccattgaagaactgtttaacacaataccgggaaatgctgccattggtggattccatgaatacggggaggctagaattaatggaatgccgccaaaggggcccttcttatggtcgttacttgcatgctgtttcagtgtgatatatcaacaatcatctttacatagaaggctagaggaattaattagcaatgtgaattttttaaaattcatgacgttatttgacaattattgggtgaaatgtttcacaataacattgctgattttacaactgataatgtgcataatcgcagcgacctggctcacgccaagatgctattatgtcactgcaaatggagcgagagctgaagaattaacagtcagacccagaaccgtgccagttatatctgtaaatagagcaagaacagcgcgatatgtggcaaataataggatagcctttgcgttcgcccttgctaatccacagtacactataactagtgttgcagatatgctgaagactttgcccaatccgaagaaaccacctggtcgctccaaatgtgagacacgtgagtctgacgacgattcagtgactaaggctgctgtggacaatccactgcttagttctcaacgactgaatgtgagtgtgccagacatcacatacgaaacccctgtggttatcagaccacataaaaaggagtcagacacagtcataatgatgccagcgcttttcaatgacgaaatgcaagaatgtatgaggcaagaaatgaagccttacatactgcaattcacagaaaatcgcgaggtggcgcccttctctaagacatcaatgaattatcttagaactgtgatgattcaagcatgcgctgcaggtaaaactgcatgcgtgattgatgacgatccagtgaactatccactagatgggttctatcattatatatgtaataatcgacccagagattggcacgcacaccttacgtctattgatcatttagcacagacaagagccaatggttataaaatttggataaagagcgcgcccttgtaccaattgaataatagatttgattatatgctgatgccattaactcaatatggttacgacataagttacattgtgtttaaatgtctgagatgcagcattgatatcatttatgccattgaatacaactcattagatttgtataaggaagcaagagggccgctaccaggcgtaggattgaaatggcgagcattagggaatggcgacaaacatacaactttcgagtttagtccaatagacgatggtaattcaaaatcttacttaaacagagacaatgttttacgacatatgttaaccaaccaagtgcaaatagattcgtttttctattgcagatcagtaatgctgcaatgtggcgacatgcagttggtgaagtatactaggcgaaacatcccattaaacgacgcaactgtaaaattatcaaacttttactgccgacatttcagtagatgtgtttcaccattcagaggttctacaccattcacgaatgctaaagcaaaagtgatgatagctcccactagcacagtatatgtcatattagctaaattaagagatcaattggtattcaactgctctagcgttgccacaacattatacactttaagatctgtgtatgaaaggaatataatagttgcatgcgccaaaggatggatcgaaagagctgttgactgtaatccactcactcaaactttgatgcatgccgcgcatttttacaaagagctgggtcctgagaacgacggtagcgatatgttgacacatgtggatactacagtttggcgttacttaaagctaatattcagtagaggatacaggcgaaaaacttttgcggccagggcagccaaaaagttttgccatgtattcacaaatgaagaaatgattcctgcgatacaaatctcaatcacatccgacgagttacaagagttatgtgatagaaatgtctacccacacattcactcagataatgaatatttcgattattttccaagcacctttgcgttcgctgatcctgacgaatatcgtcgtatgttcacagacttattcatgccactacgggcattcggcggattgtttggaaactttatcgcatgcttgcaagtattgctcataggcgatgaaattgatacagccagggtagccggcgaatataatgcaccgctattaggtgataacctggatttagaagaagcagcagctatagctgcagagatgcatgaaagcttagaaagagaattcgctatagaaggaaggttcaacacaaatgaattacatgcagctgaggcgctggaaacaatgtctagattgcgtacgagcagaacatcaaacactacatcactagatggaggtgtgacacaaccaacctctggctccatagagccagatcaactaaaaattaaagaaaggttgctcggtcatccaacattccatcacacaatgaatgcgatacatgaactagaagaatataactcggtaacaacccagataggtgagacttacaagacaacaaataatgctctcgttgaatgtgtttttcgctgcccagatttagcacatcaatttgtaataaataattgtggtctaattgatccctgggaatatcatgataaactattatctgaaagccaaactatattgattaaaggaaatctattcataggagcggcagagacgaaagaaatggttacaagatcggtgatcgtagaacacacggatgcaggcttcgttcgtgtcaaacccacagatgcagaagcatttttcagaagattaaaagagtacatctgcatcgatggcaacacaaaagatttattttcattgcacgatgcacaattggaagatgtgcctgccggaggttgctttttcagagctatagggcaagtgataccgcaaaataaccctgtagctcaaatgagtgatgttataagagagtgcaccaccagcaatgtggcaatactatataaaggtaacatctataaatcaacaactgcaggcaataatccgacaaaaatgatctatgttcaacagaaccattgcatgaaattaagttccagccgggtaaaatatctgcttagagaatatcctaccaaaagcttgaatgagttcactctaagcttgaacggtccaattattcatgacacaattgaagagaggctgagagatttaaagaaatacgagacaaaaattaacgagctaaaaagtggagatccaaggctaaaagcgatacaagaagtgctgctatacaacatcactctagaacgcacactgatcagaaagtttaatctcatttcagatactaatgccttgtcatatctcagagccacaacagaaatgtcggtatatgacacaagatgtaacaagtggataaatggaaacctaacggagcaccatgaatattgctggtcaaatggcaagttccaacaattaaaatacaataaaaaggagaacatattctcatgcgagtcccaaggcactttcatatttacaaataaagacatcgtgtttttgagagagagaatgttactcgacagagtgatgccgctatggcacagcctgattacttacccctttaaagacttgataataactctagttaacggagtagcaggctgcggtaaaactacaaccatagacatagagcacactgtgaaccttgatatggtggctacaggaaccagagcatgcaaagaagattatatgaagcctggccgtaataaaaattattacagaacatatgactccatcatattaaatggagcaccacagtgtgatacaatgtatgcagatgaaggacttatgattcatgcaggcgaactacttatagctgcatacatgtgccacgcaacaaaaataaaaatatttggagatgagcaacaaattcccttcatcaatagagctttaaattttgcaatgcataataacttagtaatcccagatgaaatccgtagacaaaacattacatacagaaatcctaagtgcatgcttgcaattttaaagcagttctatgaagatgtggaaattggctctaacgttgaaggagaattgcgaaagattaaaatcaatagcgcaacacaagtgttagacgactacgatgcctatttagtatttacacaggctgaaaagaaaatgttaaatcatttacctaaagagaagatatttagcgtgcacgaagctgaaggaaaaagcttcaaagatgtcgctctcgtcagacttatgccacaaccaaatgcgattttctcaagtgaaccgcacgtgcttgttggcataactcgccaccgcaataaattacattattgcagtgttctagagaatgatttcacatggcagactttgagtatagagaaggagactcctgaggaaacacaggaaagactcataaaatgctttgatccaatacaagcactgcctgttacacctccaaagaggatgcatgcaacaattaatagaatatgcaaaatcgacccagaatacaacgactgggtggaatggctattcagtcaaacagaacacatcacaatggaagacattacctaccaatgggaactattctcaacggaatggccagaaacgataacaccttgtaaatgcccagaattatccgacattcaagcactatattatctcatgtatgctccgaatcccaaattggaacaagagcgattaaagctaggcatgaaattccctttaccaaatcaagtaaaggtaaatccactgagattattaaaatcaatgtttaaaaaagcaacagaatatttgataccgaaactcggaaccaaccagccaataagagatccaggggatatatgggccgcaatgaatgcattattaaaacggaatttagatcccccagtagtgcactttgcaagaccacctgaaataataaaattgattgtggatgtattctttgacacttacattgatgcaaatagattgaacactacaaagatgtttgttcctttcggcacaaaagcacacacatattcatggttcaactcaagaataggatcaaggaagaaatccctaataagctatggaaaaagaatgccatctgaaatacattatgcaacccacactagacctgatatgaaaccgacattgacgggagcgcatgaatttgaagcagcaagcggccaaacagtgacagcacatcatccaaccataaccgctaaatatgcaggaatgggacaatatgtttcagatttattaaaggcatcattaaaagatcaatggttcataaatgatggaatgaaccaacaacaattaaatggagccactaacttcattctcgaaggcgttaaagagttcattcctcaagaagttgattttgggaaatttgacaaatcccaagaagaaatatgtttagctgtgcaattagaggtcatgagaagattaggagtatctgagcacacattagaagaatgggaaaaagcacatcaaattacagtgctaacatatcacacacttggtataagcttaaaaacaaaataccaacgaagaagtggcgatgttatgacctttataggcaacacaatcgtgctaatggctacgttagcatttacacatgattacaaagcagcctatggaggaatattcggaggagatgacagttgggtggctttacatccagataatgcgttgacagattcatcgagcaatattgctcaaattttcaacttaactgcaaaattagaaaattttaaagatgcgcagtatttcgctggaagatttttaatacatgcggaatcaaactactactgggtgccagaccctgtaaaaattgttactaggttaggaaggcacgattactactgtaaagagcacttagagtacgcctggatatcattttcagacaattatagaatgtatcaaaacttagaaatcaggctaaaagcctgtttagctgcagctgcaagataccagagaatctcaaaacaagaaatttatgacttgagtttatttggagattttattgctgcgcttaccctaaacaaaaagaactttttaaatttatttaagagttcttggaggatatggaatagaaaactacccaaagcgcttaaagaacaaattgggcgacaacagtcacgccaaagaggacttgtggatatcacagaaagcacagacccctttgaagaagactttttaatatttatgtaaaaaaaaaaaaaaaaaaaaaaaaaaaa

SEQ ID NO: 495 - DNA, 2010 bp, Unknown
  derived from dsRNAs of unknown virus
gaatattatagtcttatctatgtcatatcatgaacattaatttctattcaacgtacagtgttggtgtcaaaacacgactacttggaagaaaattacttcgaacaagagcgcgcgcggcgataggatcatttgtgattggcaatgccaaaacgaacatcgatccaaacgcgctgctactacggaaggatagcgcacgcatctttattgtggatgcaaatgattttaaagatctaatgcgcaacatgaaatatagcgcagagaaagctattgcttactatgaggcggtgacacaaataccgcacaccgttaggaatctatatgcttatacaaataagagacataagccaccatcgagtgggtcatcgggcatacggcgtatgccaaagataatctggttctctaacacatgggataggcactcatgggttcgcaacatgacgaaggaagatggtggatacccatgcttctggactaaagatcatagtgcgatcactgacccatttagtaaagcatggaaactatacgacacgaaatttccggatagagggtggaggataacttatgacgtccacaccgatattgattcggtattcactgagctaacgagtttcattgaaatgcatcaagacgaggaggaacttcacgtctggatacaaggcactttaaatggctcagaccctccaatggttataaatgatttaaagaagctagtctctggattaaacctaaactcttcacatataaacgagaatgttaaagtaatcctgatgccgtcaggttcaggaaaaacattttactcaaaaatgtttgagcatgtgatagatatcgatgacatatataatggagcgacttcaattcaaaaacgtaaaagaaaagagacaatggaatcagagtcttggacactgcataacgaagtgaatgcggaaataatactcaaattttatgaagatggtggtttaaataacaaaattctattaactcacggcgaagactcattacgtaaaataccatacgaaattgttggtaaatataaagtgccaatgagtgagctagcaagcgtgttagaggaaagatcagacgatcctttccacgtaaagatgactaaactaaattggtcaacgtcaaattatagtattaaaaaccgtgatgaaataaaagacctaattcatcagcaaacgtcgactatggctaccgatagtgaaataaaggttgacgtacgaaatactgaatacacatctctctgggatacacctattgagaagtcgtatgatctgtgggaaatgtatggttcgaaaactccaacacgtattcccgtaattccatggcgagtgagtaaccttgggccaagaatatataagaatggattaccacctcaactattcccaagtacgactatcatgaaaaagctaaacatatcattagatggattgaacacgactgaaatttatggaaactatagtgaattcgtaactctcagtataataagtgagtctgatataaagactttggactttggatggcgtgctgttggaaacaacttgtatgcaatgtctgaaatatctgaggataattacgcggatttatacaaagttgaggatataaaattcttcatgggatgtggctcagtaataactgccgcacatgcatgctttggagtagggagatcgaatgatgaattattgtttcaactggaaaggaagatgaatactggtcatggcacatctggccatatgatcgcaagtgtgttagctttccaaagtcattttctgtggtatttagaagaagtatttgaaaatttccatagtggtaaaagtgtttacgtaaccaagttcaatgaaccaggatctggtgcgtaccacacgatacatgaatatagaaatgcaatacatgatatgaaacggtctgatacaaataagttatatccgggatatgctagaaacaatctaggaatatgcgagaaatttgtcagtaatctacaaatatagaagggaataaggctatatgaacatc

SEQ ID NO: 496 - DNA, 7454 bp, Unknown
  derived from dsRNAs of unknown virus
gtcaatttcaggtgccgtcctggttgattggagtctgtggcgtgctttgcgcattctgctggttggggtctgcggcctttctaggtgacgatctttcccttacaactggcagtctaagtgtattgcattatacgattccgttcccacatgtggattacttctcacgtgtgagttcgccgcgtggtggactgacatagggagacacagttcgacgtgttggtttgggagaattgcacctgacggtgtgacagtgcttacttaggctgtacttctggatctgcgcaaactctttgggagaaggggttgaacgtgattggtgcaaacgcagcgcagttacaggcggctatgacttaggtcaactttagcctggcggctgtccggtgaatagctcacgctccgagttggagcgcaatgaatagccgggacgagggacgagtttggggggtcttgacatagtatgccacttttggtcgggtggtgtgctgccccccttgatgggctctaaatcgtgtgtaaggggcgacagggggttcaagcctcccaaagcctaaagctagacgacaagaacgtcgactagcctaacgcccgtagccgggaggatgatggtgccagcacagtcgtcttctctgagcccaggtctttattggccggttgggtaatgaagagaagccgatagtaagcgtgcgttgtgtatggcggcatcctccagtatgtggacagctttaaggacctcacttgtagcggagtggggccgctgaacatactcgttgatcctgaatccagacatggataggggatattcgcactggccgcacatgagtgtcgtcagctcagagactgaacacgggccctccaggagtggagtgaagtaacagtccatgttacgtgcgttgtcgcacaatccacacaattactttcgggggttgaatctgtgcccgatagttcgttcatcgatatgacgaccagactcaacgcatacgctgacaagaccaacaattgcttgttcccgagcgacggggacaagccggccgatgaggccaacgcgcaaaagaccctctcagtgattctcgccaacgaaggctcggttcgccgagtgcgggtgtcgcacgatgtggcgggcgtgatgcaagcaggcttcggcccatcgcgcctgctcaagctcactttcagtgagagcggaacgaaccagcgtgggccagccaatgactcacgtgtcttctgcatcgatcagagcaactacacgtccactggtgagcgcgcgccgatttcgcttgacattacgaatgtgtttgctgagcgttccgaggcgtcgcaggctgagattgaccgtgccaagaaggttgtgcatgtcgtctatcccggtatgcctgtgatcgacgccggtgagttcatcgacacggtgtcgtgttacaacgacgccaactccaacaaccgcagtgccatcgttcagcggctccttgctgtgtgtgaggcgtcgctgtgcgggcgtgcttcggctggtcctttcgttgctgtgcccggcggtgctgcttaccccaacaacacctacctcctgtggccgagcaacatcccaagcggtgcgcctcccgtgctgcccgttgctgtgcagtataccacgttgatggacaagattcgtggtatgccggagaaggtggtcacgttttgtcccggctctgcgctcacgacgagactgacaactggggctatgtacgcgctctttcgtgcgtgcaagccccactgtggcttcgccaaccagtattccaacaacgcgcccggtcttgctggcaagtatgagggacagatttatctgtacttctacggcaatgccaccaagcgtgcgcctgctgctgggcccgttgtgccgcctctggctgccggcgggcccttgaactggctgaacgtctctgctgccatcagtgcagtctgcgatgtcgatggtgctggctcgtactacgaagctatcatcaattcggcgctgcttgtgcggttcagcggccctgagtgtctgcatcttgaggtgcgcgctgaggatcgcttccgtggcactccggcgtccaacgacaccctcaaccggctgcacttgctctacgagctgcttcacgacctcgctcaggcggggtggggggtcaacttcatcgctatcgtcaatgcggtgttcgcaatcggtgctgtggctggcaatcttgtcggccacccgggcgtgcccactctgggcgttgctgccatcaacgcagcaattcctggcgctgcggccggtcttcctgaggggtttgttcgcatgtgccagtcggcggcgagcttcaatgcactgactagtcagatgctcacttctgagctgcaagcggtcggtcccatcgtgcaaggcttcaattttgctgcgtaccttactgttgctgtgcctcctgctgctgcacctcctgtggtgcccgctgctggcgctgctttcgccgggtttgactatgctagcgcatactcactcatggcttgcggcgtgcaaggctctggctcgcaggcgctggacagcggtctcaccgggctttttgcccatctgggcaacaagaccagcgtgtacgatcgtcagaaggcaaccatcccgcgaggcagccctgagacaatgatgatgggcatctatatgccatcactgctcgttcgctgctggacggactattacgtgagcaccctgcagcagtgccagagcaccgtctctcaggcgacagggttcgtggacctcaacccgccgaaccttgatgtgaccgatcactatggcatcgctgtacccgacatcacatttctgcgtggtgcggatgctctgcagcatgtgtcgctctgcgttaagcagcgtttccactatggtggcgcgctcttcaacagcgtcggcgccaactgcaacacggaagaatgctcgcgcctgaacacttgggtgatgcctgttgcttttgagcccaacagccgtcgcgtgatctgtggccgcgattgggacatgcccggtgtcatggccctcagcccgcagtttctgtcggcggcgcgatcgggcgacaccgtgctgtggcgcgcaaaagggctcgaaaatatgcgctatcgtgacattgttggcatcatggtcgagctcgctcggtatggccaggcgcgcatcagcctggcgttccgcatcatggtggctgccagtgccatcaacgatgagcccgtcattgccctgcaggccgtacctgatgtggtgtgcggagcccgcgcttctgaccaagcgccgtacctgcccacaaaggtgcttcccggttcgttgttctgctctctcatccacgttgggcagttgcagcttgttggctggcagcgcactatgccaacactgtttggcggagtggggttgctcggtcgcctcactggcggtccagacaacgccaacgccttcccaacgtatggtgcagctgccgctgccctgccggtttcgacgagctttaaggctatcaacgacacgcgtgtgttcattgatcgcgtgcagcccgtgcccgtggctgctcctgctattcttggtgcgcccacgaatcgtgaggtgctcgactggcagactacgtttctcaatgagacgttgcagtcccggcccggcgcctggtctagcgagtgtgcgccattcttgacgccgtttgcttccaagcccgtctggagcaagctttgcggcgttgacgaagttgaggctaagacagcggtggagaagatgctcaactccgaggacttgggcgccccaccgttctaggatagtgtggtcgacacggggtcagatcctcttggtcggctgtatgtttccgtaatctgcagcttccatctgaagcgtggcaagcgggagtcggtcggcgactgggtccacacccctcgtaggtttcatgtcacaagagtgatgtatgaacatctggttgagtgtgtgaagtgtgatgttatatcgatagctgtgtttagtgattggcttgaattgtgttttgagggtgtgaggcctgattgggtgtattctgggttaatggctgtgcgcagcccgcgcgtctgggccaacttgcgtgcgatgatggctgaacgcccggctaaactgcctaacgagtgctttggtaaggtgtgttacgatgctgctcctgagcatcgctccagtgtagtaggacgggatgacaagctggggagtgttggttctggtggtgtgctgttgtgggcgccacctggctcggggaagacgcatttctgcctcactgccaaacctgtttcaggtttagctgtgcttgatggagatgaaatcatgaaagacgcgggtctgtggcgcgttaaggacaggctcatgcgtgagtctcacgactcgaaacggctcaatcagttgctgcgccagcaagtttatgagcccggtgtgaagttgatgattgctatggcggtgcgcaagcgctcagtcgtgatgacggcggttgtgccagactatgcaatcgatgcggctgatgcagctggtgttcgtgtagtggcatgctgcccgagcgaacagacagttcgatccaactttgcgggcggcgcgcacgttcgcgtgccagggcaaccgggtctggaggaatctttggcgaagaatgcgaaaacgctgggctcgatgcatcactttggtctgcatgttcatggcaccattagtgatgcattggcatcactacctgatgagcagtcatatcgtgaggaatggcgccaagcatgcctgacgtggctggagaagtttgtgtcgggcaggtccgagtggagcgacaccttctatcgtcggctgcggcacatgttccctagtagctctgaagctcttaggcaacgtgagaagttcagcatcagtttggtgttgaaaatgtggcgtgtttgctccgtgccatcggatatggcacgtgatttgcgcttgattgctgagaaaagtctgggcatgggtggtcagtttcttgtcaatgccgcgctttgcttattgctcaatgttagctgcagacgcatgctagtgggcatggcggggcttggggttatgcagtctggtcttgcctggtacatcaaagtggctaaggaggtgcacagcgttactcgaagtgcagggtcatgctggtgtccgatgctcggtcttactggtgatgaggactatgtacaggtgatgtatgttgacatactggccggtcgattcagcttccctgcgctgtcatctaccgatgagatcatcactcgtagcgttcatggtcgtcctcaacgagcctacacacgtgggggtggctggagcgaagctgagttcgagagacaggttggcgtgagcatggatcgaattcttgcaggtgtttgggcagcaaagcagcgcggcgataagcacaacgtgtctgcgtcaatagcacacttcacgtcactaggcacgtccggtgctgcgtcggaggcacgacgtgtgaatgtcgaggttgctggcacccgcgagcagctgatgagcccaacaaagaatctgtggctgggaatgctcaacgagcgtacggtctctcagtttctcaaggacaacgagccccaaattaagggacgtggcatcgacaagttcgaatcgtccaagctgcgtctgctcttgccgggcccattgcgccattggttcattgagagtattgcgctgtggggtgtcgagtcacacgtgtttaagaataaccctgacatcgctttggaggaatctgctgtggaggagcttttggcatacacaacacgcttgatgaacttaggcggtcgagtcggtacaaaagggtgctcagacttcaaggacttcaacatcctgcataccttccctcgcatgaagcggcaatggttgaagctggccgaagcagtgtggcccgggggtgatgtcaacgtctttcgtgctgaatggggtgacatgactctggcggagtttagcgctatggcagcacgttggtgttgtgcggccctggattctgtagaagctcgtggtggcaaggtgggtgacaactgggtggagttggtacgcggtttgtggacagggtggcgctcaacgacgttcatcaacaccactcacaacaaacactacgattatgtgatcaccagcacagcacgtgagatctacggtactgctggtatggtacgcacatcacgtgttggtgatgacactgagggtgactttgtgagtgagtatgactgcttatgctacatgtcagtcatagatcagatgggcttggatgcgcaagcggtcaagcagctggtatcaaccgagcgccgtgagttcttgcgtttgatgtatgccaacggggagatcaaaggctccctcaaccgtgcgatcggcaacgctacgagcagtgatctgcagggtgaggcattccagggtgggcctcaggctgtgcaggctgccggctccattatgaacacctggttgtcacgcggcggcgatccattggccatcgacaacttctggtttccagtgctcacctacatgggcagtgtgatcatctacgttgacggctctgccaggcgggtcgcaccctcacacggccttatatcggcttgtagcatgaagggtggcttaggggtagtgcagcgtgggtgcgttgagcaaatgccaacaagcgctattaccaagatgcgagcacccaccagacggcagctcattcagcccatcgctcgccagctcaggggcgaggtccaggacatcatggtggcatcggctgcggctcaattccacagtcgtggatacaagttgagtggtgctgatgaggtgaaggatgatgttatgagtgcaatgttgggtgccagtctgccacctagcgcgctaaaggctgtgcagcgcagtgagcgcaactgtgttgctgagtggtacaaaaacaataggggcgtgcagactgtggcggtcgacgtccccagtaggattgagaagatagttggtcagacattagacatttgggcgataagctgcgctaggcagggtatgccgccaagaggtgttgcaatcgagggcagcataaattcggctttggcgttggcaaaaggaacgctggcttgcgtggatagtgtgctggatagggttaagtcagtgggtagtggcgctgtgagtatgtggcgaaaggtgcgcgaccttggtggacccacggtcgttgagttgacgaatggtgttgcttctgttatcggtcaatcgatgacggaagcaattttgggtggaactatgcttctcactattccctcgggcggaagtgtcggcagtgcgcatcgcgcattgcttgacgcttgcttctcggcggttgcagaggatcagaacttcaaccaaacactgttccccggagatgctgatcatctccaaaacagtgctgctgctgttgcaagcgcagtacgaacacagctgctggcccacgagtattgggggccacagcagcaatattaggcgtcatacgacgcttgttgctcatctcgtttcgacgagatgagcctcgagcgcgcatgaacgcgac

SEQ ID NO: 497 - DNA, 1142 bp, Unknown
  derived from dsRNAs of unknown virus
gaatattctctgaagcaatataagttaatacaaaatgcagtattacgcagcgaatgataatgtgcagaaaccacgccataattatggacaatcggacaaacgtcgaccacaatacggaattgatctaacaaagaagtatgaggctgaagaaaggatgaagagtcatgaaatggagatgaatgaaatgcgtatgattcttgataagcttagtgctggtaaagagtccattccaatgttctttgaccctaaggatctagcgcaaggttcatatggagttcatatcgataaatatcttggacggagtccgtcagacggaccagccggatacatcttccaaaaagtgacatactctgctggagctgtcgcaagtaaaactaacgtcgctggaatgtataaagtttctcccgatcacttgggatatatctaccatgatgctgatggtagtccaagctcagccgaaaccacaggagaattgcgtatcaatgaagacggtgctgatctagcatcaggtgatgtcaacccacaaggaatctcaggagaagcgagacttgtgccgggtgacttaatcttgggagcaatcttacaactaatcgatggccgtgcgggtgataaccgtactggatttgtgacggctggcctcgtctcgaatgaatcagctacacctgatgcgtatggacccaacctagctaatgatcccagtaccttcattactggaagcgccattagtggtggtcgcacacatgcagcaagtggcttacaagcatgttcggttgccagtcctaacctaaacatctataatccaacgattgtgcaaactgctacaggtgagcttgcaccaggtcaaattggtgctccaatcaatgcaattaacatctctggtatctctcctaactctacatcaagccaggtgagatttgtacttaatgtgtacgcgctagttggtgcacgccagaagacgatctcgcattacactcaacctgacccctccttcaagatggaatgccttacgcgccaattcgcggagcacccagtttcaatggtgcattaaattatttaaagctaaaagctacatcatgtattaagtttatacagcctcaaatgcggtatgtcaagccgggttcacattaatgagatgaaacatc

SEQ ID NO: 498 - DNA, 3046 bp, Unknown
  derived from dsRNAs of unknown virus
gaagaaatagaacacagatttgaacagcgcagatggaggacagatgggcctcgcttgaagctaaactcagagaggaggtcgtcgctgtcggtgcgccagctgggaacgtgggtaatatccacggcctggcagatgcaccgcaacatgacgagctcactgttgagcagcgggctaggcttgaaaccatcaccagaactgcagttcaaacggggtacacgagtccctatgcaagaagtcacgtgttacagatgattaaggatgccgagagtgtcaatgccgcgcacgtagtgcactatgatacactcggcaccttgaatctgcgacgagtcactggacaacgcgcgagcagctttgcctccgcgagattcgacttccttgcgtcgtcactttcacagtcgcacataatcgctcgtcttggcaaggagattggcgcaagatattattcgaacgtcgcctcaggtaggcgacaagatcgcgactccgcgatctcaacaagtttgactgatatcgtgcgctaccttaagaggtgtctagcacgtctggatgtcgcatccgctgacccgattacgttccgtggtcggtcgtttaagtcgaagattgacttcttcgcgcagcgtaccgatctggtcgtgactcttggtctgatgttgccgattgagttcggtggcacagcaacgatctatcaggtcggtgaagccctcgaacgaggcgatgacaaagcggagggcttgccttcgttaccaaagtacgtccatgctggagccatgctcacgcaactaaggactgcagaggtcgaaatatctttcgactggcataaggaaaacgaagatcacaccgccacagcgactttcaatgccggttatactctaacgactcaatccgcgtacaatatgggcgtcggtacacagtcaactgagttgcttacggatgagggacgcaaaggtacgtggcttacgcttatggttccgaatgggacgcttgacacaattccagcgcgtatcgttacggcacgctatggaatgcctgtcagcgctccagccggttcactagcaaatgccattgatcgagcatctcatgcgacatggcttgacggtggctatgccatagtcacagtacgactctccactggcgggtcgtactttacgtcagtgaacaatttcatgcagtacgacactggcaatggtgcgactccaacacacggcagctgttttgtctcaacgttacgtatgttctgtacgccgcgactccaaatggatgcacgtccagtcgttccgcgaatacacaatctactgaacgatgatggcatgacgcgacgcgtgactgtgtttacgtactccggaacggcaaccttggatgcaccgcttttcatggacacctacggcttggagtttgcacgtggtttgattactttgttaggaaaagcctcaggcggcaaagttcgtcacaaggcaatgctgactttgtcatcaaagctcggtttgcagatgcccaagtacgcagatgcacatattgatttcttgcggtccgtgattgtcatgctcgcaccagtgcttgagagactcacggcattcttccgggatcacaatccataccgtgtcgttggtgaattgactctcgaagaaatcgaggaacagctctacgcccgtccaactatcgaatttgcggacgcagcgatcgacgctcttaggcgtggtcgttcggccgcgtatcggtggctaacggacgacacgaacattgtcgcggcactttgtacagcgtggtgtacggtgaactctgcaacggcgctaatttggtacttccagtacatcggattccagctctccccttgtctatatcctcacagttatgataagaagccggagactggagtcaaggcactggaggaaattctcaagttgtcgtactcgcagtgggttccgccggattcgctcaatcccgatcgtgggcaagtcagcctgcaactcctgctctcactatgtaggagcgatggcccagtcttcaagaaacttggcatctgcaaagaactgttcaagacgtctccgtctttcggcccacaagtcgaacacggtggaccctgacttctgtggtacacgtccttatccccggggctcacgccagtgtatatgttgaactatcagaatatttttacataattcacagaaccatgttttcgtttcatcgacagagcgttaacatgcctggaaggcagagtccggtaatgcccaccgggcgcctgtctatcgaggaaaagattgaagcagttgactcgttatcaataatgatagaaaatgagggctcggttgtagcccaaataaatgttggaaaggatgaaaatggtgaaacttccgtgtttatgatgaacgttaatgtaccgtgggatcgtccaattaatggagttcacctaacgtacaaccgtgcgttcgaagataaaataaacccagtagaaccaaacatatcagagccagcattagctgatagttttactaatgcgttgattaaatatgacgaagaaatgtccttaaaagcacaagaaagcttagagcgcagatcaactaatgacgttacttttgaagcggcgcttaaggcgttgccacagataaaaacaccaccgcaacattcagatgcagaaacggagtcatcatattcacaggatgaattgggtgatctgtcaaaatttcttaagatttgctcagcggggaagaaatattccttacgagtcaaagcagatggtggtatactatcagagcttaaggatgtatcacatgcatcgaagtccacaaaacgtaatgtttatgtagtatcaaaaccagaaagaggcagtgacgacccaccgtttacaatggtattgtccaaaacacgccccaagcactgcgttaacgtgcgatcgttaccaattggcgtcgacatatggctaacaaagcatataccaaatcataaacagcaatcaataacaattattgaatatacgatgcttcagcaaattcgcgaagctttagtcagctttttcagtttctaatcgaatacgaactatgtagaatgtaacatc

SEQ ID NO: 499 - DNA, 3488 bp, Unknown
  derived from dsRNAs of unknown virus
gtaaaatacattttcttttaataaagtacccagttccctttgggagccgcccgcgagggtcgtcctcattttatgaggaattttacaggtagtgggcactacctacttaaccatttgattatgactgacacttccaagtctaaatcggtggatccaattgtagactatgcagatttcgtccgagatgagatttcgctaggtgttgcaacttgggctatccccgactttgatcaatttgtagagatccggaaacagctgtctaacaaagacgctcctttaaagtttgtctcacccggcaaccttggaggcttagcaggtgccgcgatgtctaatccttctatccgtcgcatgatggatgccggcgttgacgccgtttcaaaggaaggcgttcgaattgctgaaaatatagccagacggttatctgacggtgaatcgttcgtgaaaattaaacgcgattttggtgatactggaggaaactctgggcgtgatgctggtggagatggatctcccggtaatccgttcaatccaaaccgcatgaactacaaccctaaacctgttcaggttcgtttagatacaggtattcgctctaagggctatggtgattactatccagaatctaaaccgataatgaacgttctggacctaacgcaagtggagtttcgtgtcccacaaaatgctgcttcagaacttaagacttatttcgatactgtcataacattcaatttccagaatgacgctcaaatgagagtgaattttaatgtcgatgctattaataagttcagtgacgcgaatcttcgtgcatggatggacaggtatgcaatggcttatggaaaatacgtttggtacacttctatcattaactattgcaacgaaccacttcaacagaatgctggtatgcgcgctttaagaagcatgatgacgcctcagctgcttgacgatctgtcgcagctagccaacatgcttgatgggactccggcacctccgaagttccgtgaacttgttcactttatctatggtgcgccgttcaaagttagcaataatcctggttcgcaaatcagaatgatatcgccttcggttctccaatctacaaatgtaggtgttgaagtacgtttagcggctcttccgcctgacgacatccaaagtgcgattacttctatgtttgccatgcgcgaaacgacagctcttatcgctcgtgtatgtccacaatggattcctggtaaagacaacactcctgctggtgctgctgtttgtgagtactctccaaactggtctacactatgggagaacctaccttacgatgtattcgcaaatggtactgaacacttcggtcctcccgttaatggtgagaatgatgatgcttgttacggttccacagctgatacactagatggtgctgttacagcattatggaatggctatgactctacagtttctggtagttcagtgtttgatagattcagacctggtactataatactcgttcaagcgctgcgcctggttccgacccggcgataacgtctttttcgaatagaattcaattcaagtatgattctacgaacagcactcaggcgttcttcctagtctcagttggatcgaaccagttcaactacatgagatgtgaggcttatacggttacgggtaatggtgttgtgcaccagattgtctggccaggtagagagacaatcaacaatattaacatcgcttctgcccgtcagacttcgtatgagttatactctatgatgtttgatatgggaccgagcactaacgcttcatttaaccgaagtgaaaaacgtaaccctcgtcgcagaggtaagtcgaaagttagcgcttcagataacaaagaagagatttaattaactggaggtcactatgcaaattgaaaagctatcgcaatcttatctggtaagtatccttgaggaagagaaaatcccaacggtttcgaatgcacttcagatgttgcgcgaaggtaaagagcctacaccacgtagtcctctgttcaaagataagggtgaatcagcaattgttgatgattatctaaagatactttcccgtaccactggcatcactagtgatctctacgattacgaagtcagtcggttaccgaaagttggtccacaaggcggatatccaccgtttgacgacaggaaaagtagtttcgaagattactacactttacctggttcgatcagctatactgacaacgaaatcgacgatctcgctactcgagtaagagaccatcttttcagaggaaagaaagatctcagaccttggtcatacgatcgcgtcattcgtaaagggcaacttggtggcacacttgacaccaactctggttgtccatcatatggtaaacgatctgatactacgattcaggcccgtgctatcagagacgcgagttccggtaagtggaaggattacccagcaatactcggatccagagggcagagaaattccgataggtttattttcatgttccctttttcgactaaccttattgaacaaacttttgtcaatacagttcttgatgctattagaattaattcaattccaagctttagtgcatgggaaggttttgataaagttgcattaactctaactgaacaaggggtttcgagtacgaagaccaagtgttctacggactacaggaaaatggataaacactttggaccagaccattttgattttgtattccgtgttctggctcctgtatttcagccgtctatgcgtgaacaacttagagagagtcttactcattgtagcgagataccagtattagtaagtactgataaactttacactggaacgcatggcatgcccagtgggtcaggttggaccaacttagctgaatcgattgtttcactagctataatgataaccgttgaggatcattatggagaggatgctattaaacaagttcttggcgatgatggcgtaatgttatggtctaccgtaatttctgattttcctgatgtatttgcagaatattctttaaaattcggactggttagttctcccgataaacaaagagtagatgcgaaaacttttacctatctgcaacgtttctttgatgttagaatcagaacacaattaaacggtaagaatgtcgtggcaggtagttatcccggaatactagctttaaattctgcgatgaacccagagcggttccacgacccagtcaaatggagtagtagtatggagtcactccgatggataatgattttagagaatgttaatcagtcacctgttttccacaatctaattgattactttattaagggtgataagttcaaacttggacttgtgatcccaggctttcttaaacgagggatttctcagtcctatcagacagctaagacacttaaagattttgttcccacttacacaaagtcctctactgagaaggggatccgcgattttgatgtcgtgaagtatttgagaacactacgtccacgctaggggcgagtgtcggagaagttcatagaacttctctc

SEQ ID NO: 500 - DNA, 3770 bp, Unknown
  derived from dsRNAs of unknown virus
gttaaattttactaattatttagttcctcatggagccccgctccctctctctaatcgaggttaaattaacagattgagagaattttcttctaccatcttactgatggcgcccaacgggtagaaatttaaattaacaaactattatgtcaaaccccattggcacaattttctcatcattcggtatcaacgatgatgagataacttctcagcaatcatcttggcttttaggcttagcctatgatgcccttagtgataaatgtgttgaagatggaattaaccttaaaattacaagagatgaatttattgtcgaatacagtttagcgtatgctaaaccgacttcagattctattttggagtattacactaagatttcaactgcaatatttgcttcaaaacacgatcctaccagtgcacttggctttgtagcacctttagcactccctgctattattggtggtactattgctgttggtaacgttttctcaagaaatagatattctacattacagaatgatattgttgaagagcttactaaacaagctggtcaagcagtccttactaaagtcgatagtctactatctgatcttgcaggtggtatacttggtggcggacctaataaaccaggaaagccagctccacccgctagtggtggtggtggtcgtggtgaaacttacggtggcactggttcaactcaaccaattggtgcgaactttgtcaactatgttcacccgactaagaaacttgagtataatcttggtattcccaacaccttaagaggtacggaaccttttgactctagcataactaatattgatggtgttgtttctagttgtttgactcttaaagttatcaacttcaaacttcctttagaggatgacacattcaatcagtattacactaaagtttggattccttcaattagggactatcttcaaggtgagaaaagactaaatactaatttagcttctcttttcactcctgacagaatgcgtgactatattgaaagggttgccgaagcacttcaaatttatcacttctttatcaacgtttttaactataacttacttggtgaaggtttaaattctaatgctggacttagatacattagagaaactatgttcagtactacgaaccttcaaaagttatcgttgctaagagaaagactagatggtttaccttggcctcagactcttgatagtgaaatcgcctaccacggttttatctacactcaatctgatgttaattatagtggaaacattatgaatgtacctgatatattcgtttccaatttatatcaaacaggtgatgctccttctactacagttattgattcaattcgtactgatgtaattcagtccacaattgataaacttgatttcaccgatctaacgactggagataatagagcgaacatgctgaagatgattggtggtatttgtaacactactgactttcagaattctaaagttagcagtattcaaatagagccatttacagatcctgtatttaatacagagtttgttaataactccctattctactcaactgtttccgatgctggaagtgtgagtagatataatgacctaacgcttatttgcccacaggaaggtgctcatgattattcaccagtacctttctattcttatactaatgacgttccaggtatgcttcaggcgacatggacagcttataagaatacaggcggtcagtggaacggtttctggagaccagttacaaatggatgtgtattaaaaacaagtgctcctgaagcaactgtattcactgtatccaatgtaatgttcttctgtgatgaagtacccaactaccaacttattgattcaagtggtagtgttactcttagaggtgggttcgttcacgttacaccagcaactcaaaactgttggttatctaacaacttcgttgaatacccttgcatcaaccttgatgatactactggtcagtatgttgtgtctaagaagacacagaaaccatacggttcacagcttatcgtcaacatgtcggtgcaaactaactttaaccaaagaactcaatactggaaacagataatggagtctgctggttgggctatgggtagaacagaagatcgaatgatttctagtcctaaacgtactaagagatacggtaaggacaaatctgaagacaaggaagagtaaagtcttctggacctaacaaaattaaattgctaaccttatgtataaagttaaccgtagttggcttactgataacaaagatgagttacctaaaacagcgtacttgaagcttaccaatctaatgaactctatacaagaaggtaatgataccgttattctatctcctattgcaaaaagagatggatgggataacattcgagaagattggatcaagttctattcttcacttgataagagtaactggcctgatgcgctcatcgaaatggaagaatctcagcaagacaaacttggtccgcgttcaatcgccaaaccttggtcggaagtgagaaagtcagtctatgattactttgagtcttcatcaggtaaactggtatgcaacgatagtgttctgtcccctttcaagaccgctggtatgagagttttaagaccgctatccactgagcagacaattcagcgtattaagaagtcaactagttcaggtcttcctttcgtaactagaaaaggtgacgtaatagctgttactatgagtgattcaatgaaagcattgtcgaggttttggcctgccgctatgtatgaacgcactcaagagcaaggtaagactagagtcgtatggggaattgcccttggccaaattttaagggaagctcctttcttctttcctctcttaaagcgaatgtctgactcgccgtggctatcagcactgctgggaccggaagcagtagatattgcaatggatcgtttgattaagtacgccatccttaacgatctatctatcgtaaccattgattttagtcgttttgatacaacggttaaaggatcattaatggattgtagttgggaagttattcgcaacttcttccaaccaagttatagtggagatcttgattctattgaatctgattttcgaaacgtaggaattttatgtcctgacggacttgtaagtggtgaacatggaataccttctggttctatgtttaccaacattgttggtagtatctcacacgcagttgcctctctaagcaccgagcttgtagatattaatttgtctcagattctaggagacgatggtgtacatctagttcgttctgaatcagtagatgaattcctggattccttcgaacaattaggaatgattgttaataaggagaagagtttaacgtctgatagatattctatctttctacaaaaactgtttcatccagacatcaatgtaaatggtcaaatcaaaggtgtttatcctattaatcgtggatttaataggctatgtaacatggaacgttacgataactttaaattagacgggataagtggagctgactacttcgcgattagggatctttcgatcatggagaattccaaatatcaccccgcatttcgtgagtatgtcctttggtgggcaagcaaatcgaaatacccaggtataccttctgataaagggattagagattatgtcgaaagaatctctgattttaatggaacagaagggatccttgttaatcagtacggtgacaacatccgaggcataaagacttggaaatcgtaccagatacttagcgaggaatccgcttaacattaagggtaatagtgatattacccccc

SEQ ID NO: 501 - DNA, 3251 bp, Unknown
  derived from dsRNAs of unknown virus
taacagacttcagatacacccgcacaagtgaaagattacgatcgctcagatagacttgaggcactatgcgggacggacgcatcttaattgatatgtccaccttcactctttttctctttcccctgatgatgttggccttcgcgatgtcttacgtcttcgacgtagtatccggtggctattttatcgtcgggaactcctttttgatgagtggcttctccatgaagtctctcttcatatttctcctcaagcaattgatccctattgcggccatggtcgccttttggaactctagcatcaggtttggtgacaatccgacgcctaactatttacgttcaaagccgaatgtcaaagttatccaggatttcgtcgctaccaacacttttgagcaacttccaagtagcaaaattatgttggcttgtcccaacggcaaattgtaccctgtctgtttctttactaggcagatcttgaacagtatcgaccctgcagcggtgttatacgcttggaaaacttacaagcgcgtaaatgacactcttgccatgcggttgaaacatctcaagaagtacgtatacggtggtaacaaagttctcagtgatgagctcatacatgaactcaaatctgaggctgacagcctattcacagaactcacatcgtctgatgcatggaacggctttgcttccaacgccagccaaaacattcacgaacgcaactatgaatgtttggacattaacaaatccgcggctgccggtcaccctcacgtgcctggcgtcaagcgccgtgatgtgatgcctgaaactttcgtcacctgtgacgagttgctggacgatgattatgcgtttgagagatacatgccgactgatctctactacactagtgggcgagccaagcttaaaggtcgaaatgaggaggactcggcgcgcatagtcatgtattgtggttttccaaccatggtgatgaccatgctttattacgtccatcttacgactttgcttatgactttccaatggtgtggtattggtaagtcatggatgaacaacggcgctaacaagttcgctgagtttttccacgccactaaaggtatcgccccggcgggcatgcgttatgtgtcagtagatatatcaggatacgacagttcacaatctgtcgaggagcttaacatactcaaagatttccacacgcgtcttcaaactcacgcaaggattcaacagtcatacatcaaccggttcattgtcatgttcgatgcgatggtctatgctgcagtgcttctgccgactggcattgtactgcgtgtagttggtggcctcaaaagtggatggtctggcacggcctgtgacgataccttgcttcacactttgatagtcagaaggcttggagttaccaaatttcgtgtctacggtgatgacaatttcatgcttgtttctgatgatattacagatgaggatattacagatcattacgccaagtttggctacactcttaaggtcattcaatcgtccactaacatgggcgacatcgatttcctttctaagtacgttaaatatgacgcttacgccgatcgttactatatacatcgtcctaccgtcgagaacattgctcggttgatcttcccagaagagcaagatcccgcgcggcgtgacgttcctgacgaagtaatagcggcacaacgtttaataggtcatctcgttgacaacccattcaactctaagtgttcgggcatgattctcaaggctcttgacgagctgagagagtattatgccatcgacgacgtaatcatatctgaggatacaaagagacgccatccatttcgcaacttcgtcaacgttccgagtaaaatcaatcttaaggacgtcacccgcgaatgggcgcaatccctctatgatactgattggagcgctacacttggtcttccttgtccaattgtttggccaactcttgacgtgtcaccaggaacatttgacttcaggaaaggggttcgaggcgaacccaacttacacaacatgtgtgagagtcggttctttgaactcgagatcgatcaaaacgcctggagtggcaagcgccgtcaagcagtcagaaacagggcttcgccttacaggcaacccaacggcttttcacaatgctatggcttccatgcggcacggactggacacgctattaacaaagcgtgtattaggcccaagactgtcgtggattttggatctcacccaggggccatttgtgacttcatgatgcgtgattccagggtgtcgagcattacatgcgtgactttgaagcctgacggtgacaagagattcatgccatatgttcacattggcgactcacgtctcactatccataatatggatgctgacggcttcctttgcccccacgacactgacctcatgatcgatgacattgatcttgttgggggaacaagattcgctgacgatcgtcttctaatcgccaaaggcgcaattcgtcgtgccttggctaacagctcaagggtcaagtgcgcaatgttcacaatttcgtgctgtgacaaggctgtggtcagcgctctctacgagtgttataaggcttacggtgattttgacattttcagacctgtgtggtcgaatccatggaagcctgagtacttgatcacactcaagaaggtcccaattggtgaggtttacaagctttcaactttcaagaaggctatgaacctctttcttgagactgaggccgtctccatgctcaagtggcaagcggcatatgagtatatgatggagaatgttcatctccatggtgacttagtctgtcctattcagatggacacggtcaaacaggagcaattctgggctaaggttaacagaccttatgttgttcctgagcgtcctaatgcggacgaggctgcgggtttatgactatcttttatgacgttgatttatcagtgtctagaatgttgttcctgagcatcctcacgcggacgaggcttcgggtttataatcatccattatgacgttggtctatcaatgtctagagttattaatccatatatattattaccacacaacactttaaattaaccaaaatacgggggagaggacgacaatggagacccaacaataccctaggagaactccatcctctcgcgacacacatttattagtcatttcgcctcataccagaagaggctgatcttataagctggttgattttctttttccatctgtttgacaatcaggtgtatattttcgctgcggcttcaagctaggcggagatgaaaaaaaaaaaaa

SEQ ID NO: 502 - DNA, 1748 bp, Unknown
  derived from dsRNAs of unknown virus
gaagaagaaattgtggttgcaagggtcataaaccgctaacttgtcgcaatggacggagaagaatatgcagctgagcttgcggctctcgaaggtgtcgaccttggaggaggtgctctttttgacggtgaaggcggcggcgccgccggtgttgaaggtgatccactcgatgaggacgatcagggtgtagacgaagtggacttgactggtgtgccatttgaagtcccaattccgcgtctactgcgtcagttcaacgacgcaactggtaacgaggaagtcacgggacgcatcgttgtccaattgaatgacttcatcatcacagatgaagacagatccatctacctcgctctccccggtctcgcagtcgttaacgcacgcacggcgggcgacgctttgaacatcgcctcagccgattcgccaatcgttcgactgtacgctactattgagtacgtgctccaaaacgacaccgacaacatcccgtcaggtaaccttgatttcgacgccgcgcttgacgcagccgccgtgccagaggtctggtcgaggctgtacaccgcaaatgtggaaaacgaggctgggatcagacgactcttcacggtgaagacgaagttttcaatcgacacgggtaatgctctcgaagatggtcacgaagaacctctctttggtgccatcaggagaaaactgccgctgtacgcttttgtatggatcgctcaacgcgcggtcgtttcgaggaatgctaactacgtgcagaaagaaggtgatcagactttcgtcattggacgacggactgacatctttaccgcactccgtgaggacgcgcctgtcactaccgcaggagctggtcaactagcgttgttgattgcacaaaacagcccacttcagtaccgcatgatgacgtatgtcctcatgcggctactgaagcgtgttgaagagcatggatcgacgacgcttttgagcagaaatgcacagacgctgctcgaactttaccgtcgtgtgcttccaacagcagacgatgtgagtgagcaaacgaacaacttcgaggacagaagaggaatgatctcactgatgctcggatgtgccattaccggcacgctttccacgtgcatggcacgtgtgaaagcgacgctggctcaaggtccagatgaggatccgtccaggttgatccaaatggtcaacatgctgttcggattcgatgtcgtcggtgccattcgaaacccgcttgccgctgaattcgctcccttcgtcagagcgacaatccgcgtaagtgaccttgcttcattggcttgtgtgtggctggcgtctaatcaacgacttccgtatcatgcgctgctccaagttgggaaccgggcgacggaggacttctttaagttctcgagcacctcacccttcatccaagcagtgctactctctgctgcggctagagagggccctgatgctttggcaagtatcaattcggacctcgttgctacgacgttccaaacgttcgcgatggcacaactctctatagccccgtccccaggcgacgtcgaccagtcgtctgtgctcggtcaagctgaagagacaattgtgtcagccctgttctacggcgtgctcacgccatcatccgcctttacgttccgaccggagacctatcttaaggatttggaccctccagtgcggcgcgcacctgcggaaaatgcacctgaagaccccttcgagggtcagggtgggcagatcatgctgtagactcacactggaccacatccttaactatc

SEQ ID NO: 503 - DNA, 4916 bp, Unknown
  derived from dsRNAs of unknown virus
gaagaatcacatgcaagatgacagagtcaaaaaccgacgaaaagtttgggactgagtacattccccgcgtctctttggacgacacagctaagacctttgaggaacagcttcaagccgatggtttcaagcttgctgacttcaagaagagcaaattcttcacttctggtgaatttgcgaagcttggtgagcaagaggaacgcatggccaaggagctcggattcaaagctagcgtcgttgctgaggaggacgtacaagctgcttcggctgaaggagacattgaaggagatgcaagtgaggatgtcaaagatccacacaaacgcggcaaacggaagaagcgtgcgaagggtaagcctgaggaatcaggtgaagctggagcaccatctttagaggccgcaactggtgtggaggcacatcttgaagccaagtcgacgaaaacggaggatccggaggataacgcagaagcggatccttctgatccaaagaagaagaagaaaggccagaaaggtgatgccgaagacgtccatgctgccgatgacgatctcaacgccgcggatgagtacgatgcggttcttgaacagcagaagaaagagaaggatgaggccgacaaactcgccaaacaagcgcaatcttcggtcgctccaacggtcatgaacctcatcatcaattgtcccgctgccgtgaagctgaatgttgtggactggtgcggcgcaaaacgcgtactcggcaacgatgttcacgatttgcgtccatacttcgttgtcgacgcgcagaaaacgcgtcatcgacatttcaacacattcatgtcgatattcatcaaggccgtccgcaacacagctccggttcccaccaaatctgtcaatcaggctggtgggcttggtctggctggcgaggagatgacgacagagatcgttgatccagatgcggacaacttcaaccttctctcatctggttcggccatgtccgcaccatcgctacgcaacgcgtatggtgtgctgagtggtgtggaaatcaacgccgttcggggtgcaaaccttctacggatcgatgaagattactcgaacctgccgaactactcgaccgacatcacaaaccaggcggctgttctgtctggagacatgtacaggacagcttcgcacgtcatcatgagtgaggagcgcatcactcgtcagaacgctggcaagcaccagtatcggaagcgggttggcagtccaaccaagtacctccaattctatgggaagaacgccattctccaacggatcaagggcacgccaaccgcactgtttacgcaggacgaggttgtcatgtacgagaacgagttgcacagcttcgacatccatcaggacatgtccttctgtatcattcgcggattcgggaacccagccaacgccattcagaatttctcactggatattctgctcgcacgcgattcggaacttggagctgagctacgtgagaaatcaatggctgcttcgcgtgaaatcattgtggcgtttcctgccacagttgaagagccgaagaagtcaggtcgagacacgaagatcaatcctgacatggtcacggctcaagcgatgttgacttcccaggatgcggcaaggtgggctactacctgttgccagtactacgctggaggtgcttacatggagatgtcgatggatgttcctatcgaccagtacatgaagcatctcgctccgttctgtgccgcagcaaacctggtgatgattcacttcccgtcgttggacgttccaacgcaggtgcttaacatcaatgcggtggcgcgaccgttctgtggcgaactgactgatgaactcagacagtacctgcttggaccagtcaacgttccggtgatcttcgccaacgctgcgatggccaacatcgctgcgtatggagctcctggaccgatggtcctactggcccccgctcttcagcgcaacgttctgcagcagttctacaactgggtgagatcatgtatcttcccagtctacgacactgctatgggacctggcgctgatggcaggtggtggacgtatcgtcaggatcggcggccacgcgagcgtaacggcactcttccaaatcctggtaccgccttgctgaccacatacggtcgttgcaagtaccagaagggtttgccggtcggcggaaactactacgatcgcgacatgcgtgctttcactccctgtccaaacgccatgtacatgtctgatatggctttgtttggttcggacatgatgatgcgagacaacgaaaggaatcggacagcactccgaccttacatgtcgttgtggaccacattcatgaggttgatcgtcacagcattgactgcagatgagcgacgcgccctggtactcttccagaactttggcgacgacttggttcagcagaaaggttcggggatcatcagaatggggctcgctgtgcgcaacgcggcaaatcatgacgatacactgcaagctggaccgggttactccggcgtcgttcggaccaatcttgatccggccggcagtcggcaaaactacggtacgatcgccgtggaattcactggcgcgttgtccttcctcaagtatggcactgatctcctcaacttcgaggaagtcaatgagtttcacgccatgcgcgaactgtctgaggatccggtcgttgcctctcgcagcgcagtcgaacgcaagaacaggcagatgtccatctacattgcgaatgaggtcatgtctctctgcaccgacccagcgatcatcccagagctggtcgacgtacgcctaacggcagcacttgcgcctggagcgaacaacgagtacttccttgacaactacactgatgaagtcgaagaactgatcaagaagttgtcgcaggtattctatccttcaggaagttcagtcgaagcgtttgcactccgctggtatcacgatcgtgaagtcaaccgacaggctggatcacctttcattccactgtatttcgactacgcgccttttcaggttggcggcaagtctcgtctgacgatcactggcttctcaaatgcgaacggtcaaaacatttccggatgtggtggtgtggctccgaacgatggtctgggattcgtcatgcccaatggtaacattggcaaccctcagataccacatcttttgtcttctttccacgctccgatctatgaggaccaaggggctgtcgctgctgctgatggtgtattagggaaacgtccactcgctgtcatgaacgttgccgctactgttgggcttcttccacaaatcgcgcgttcacacgttcggctcgatgctgccggagtgaagagttgggcaggactcacctttggcaagttcttccgttacgttctggtctcaaagcacgctttgcttccctgcgactcctacggtaagcggttcttccgcgttccggccatgaagactgtccttgtacgaggtccagtcggcaacaggacggctcaggagtggcgacaagatcaggctagggctgtgaacgcctgtcttccagatgctctcacgaacgcacccgcaccgggtgacgttttgagtgcggttgcaccagtcgtgtttccgctttcaaaaacggatttccagaggatgaagaatcgtggacaccccgcgttctttgaccctcagacgttcgctcgtttcttcactaacgaccgaattgaaggggattacacattcgaggacatcaagaagttcatggaaggaggaattgacatgcgtcgtgttccgaccgaggccgcgtacgtcgccgctggattgagtgcacagttggcaggagcccttgcgagctatcccaacattgccggcgttttgtcagatattcactatctggccaacacgcagatcaatctcaccaatcaaggtggtgctggtcttggagaagtttcgatgcgtacattcaatggtgcgattggccacaggtcgatctacgggagtggtttgttcatatacgccgtgcgcgaagcgtttggcaccgcgcctggagctttttacaacggtcaggtcgctgatctgctgccaaacggccagcagcgagcagcgacggtcattcctaacggcgaggatgcagatcagcttctccgcggtgcagtcaactactacgcacagcatcctgggttgatccaaaccatcatgaatgcggttctttccgttgcagcgttcgaggaacatcctttcgtcatgttcaaagccccagtcgagcaggaatacaagcagatcgacgatgacacgtcaatggaggtaattacgcctccttccgtgtcggttgaattcaagaagtacttctctgctcgtggcaatctcgcggcaatgcagcctatcgatgctccagtcgcgcctttggacgcgatcaagacatcgatgagtgcaaaggttgtggttcctttcacgaccacgcttcgacagcacgtcgttgacgctcgcgcatacgcagtcgcaatgaatccagacgtgaacgagaatggtgaatacatcaacccataccatccaacacgtcatgatgattgcatcatcggcatcattggaacgtatgaggctgcgtacgatccagctatggtcacggacgttgcacgcgagtccatcccaaccgccgagaccgcggtcaggaagggcgacacgtttctgcgatggcctgccaagattccgatggctaatgcgcgacgcgctacgaacctcttcccacgcgctccagcaatcgctgccaatccgatgcgacgtttctataccatcgcggacggcgagaacggcggacctctgatcaacatgacagcccacccagtaattgtacccaaaaagctgacgattcttcctttcgaattcgaatcgcctcgggtcataagtactcgtccaatttagacgcgggtgttgctctctctcaaacaatccggtcatcactctgtcagtgcatcttggggatactacgtgattaaaactatc

SEQ ID NO: 504 - DNA, 5842 bp, Unknown
  derived from dsRNAs of unknown virus
caatactgctcctgtagcagttccttccgtatcgtctgttgggtctgtgagtgcatccgactgactttcgtaggtgggggcgtttaaacgcgtcacccgccctgcacaccgctgttgacaagtgcagtgacaagccgtgatggctatcacttcgccctttgaattagcggaagtgcgcttggcactcatgtgcgggcaagtgcttcatttctttacgaagcgcattgaatcaatggtacaccacgacgcagcatgcgtggcggagaacgaccctcacaacgaggacgtcgctttcgccaggtatctcagcggggttgctaggctagcgtcgcaagacgtgacttgcctgtgcgtaccagtgagtctgctcgcacggtggcacctacagcacgagatcatgaagatcaagactcgtactacccaagccagcccatggtggctgcgcgtaggtgccacggaggtccgcggcgaacaccgtgcgcttcggctcgtttcacgcatcattgttggagcgaccgtctcgcacaacgtcgaggacaccccacgtggcccacatccgtgtggcccacacgtccactctggctttcgcaaactcgcacagcgatttgaggtccctggggccagccagggtgacatcgacaacacccagagcaaccaccaagttgctggcgcttctcgcaacgtcggcgtaggcaagacccgtagctacatcaacaacaacgggttccagacctacgacgtcagcaagagtgccgccgcgcgtgataagctcgcgtttggcgtgcgcgacgtcaatgacgtcaaagatcttgcgcacaccgcattggcgaacgtgtatgcacccggagaggtgttctcgctcgtcgacgatgacatgtacagggattcccttgcattgatagcgggtgccaacgcggtgataataactccgggttacaacaagtgcgctggcaagggcacagattctgcatggtggtttaccgctgatgcgaacggtgacatttcagtcaccgagcgtgtcgctggtgtcaacgccgccgtgtaccctggccagcgaccgtggaactacaccgagaacgacttcgtttacatcgcccatgcttctggcgatgcgttcaccacttataacgtgatcatcaagtaccagccgggctcccaccacatgtgggtttggctggctcgcaacacgactacttggctttccaaggaaatctgcgacatgatgaaaacgttggttggatgtacggggttgggcgcggtggagctgcgcaaggccaccaacgtgatatgtgtcacgcccgcccaagctctgcagaggttgcccaaggctaccgatgagcagcgggacaggatggagaagattgctctcctgtttggcggcccgaatccacgatcattcatagtcgggctcttcgggactgacggcgacccggtgttcagcatcaagttcgccgactcggagggccccggctcgtccgtcgagatcacggaaaaccagtaccgcgagttcgacctcatgggcaacgccgggaaggcgaagggctttggggtttcagaaatcaagcgcaccatgctctatatgggcaactggcgcaagggctctgtagaaccgattctggttggatacttcctgatcccgatagactatcgaccgcgcccgaacatcatgtacgtccgtcaagatgggtcagttgacgatgacgttgatggacgagcaagtgccgtttgggctgcgccgaatccgacgcatagcccagcaggcgtggccgatacgacgtccgatcaggcgcatgccgcatacaaggagaaacggcttgagaagtacgcgaacaaaaccgatccgtcggagagcttcaagctcgtcgccaacatgcttctgaacaagttcattgctcaagtctcttcggagactggggtggagctcaagtcgttgatgttgccttctgcgaagcacatctatgagactcgtacgggggcggcccaggccgctcgcctggaaggctttctccacaacaacgcagtcgcacccaccgccaggtcaaacctgaagagtgaagttgctgccaaagcgagcatcgcgccccgctgcatcacgcagtaccccgaaggactctcgatccagaccggccgtcttggctgcctggtcagtgagatcatgaagggatgcgggtactacatgccttgcaagacgcccgcccaagtggcacgcgcaattcgcgctgtgtccgagtttacgctgttcgatgcggagctcgaggaggcggcaagcaaggatgtcactgggactcatgacacggatttcaccaagttcgacgagacgatcagcgaatacatttacagctggttttccacgttcgttcttgcattcgtgacaaatggcgacaaggatgaggtagagaagatcctgaaggacaacgtcaacatgaagacgacactcaagagcaccatgattaagaccggctacaagaacaacagcgggtctggtgtcaccacggggctgaacacattcgtgtccgccttcgtcgagtacctctccaccacgtacgccatcgttcgccaatcaacacggttgtgccacaaggcgagtcttccgtatggcttgatcacccgctcaacggtccgcaagcacctccagaagtacatggagaacttgccgctagagtggttgtgttcacaagtttacatgtgcgaccaccatgaggtcgagaaacaggtcgccgccggtaaatccgttggcaccatcctcgacatctttaagatcccctacttcgcagtcggacctaagttcggcgacgacggggtggccgcgcagttgccatacatcaccgacgtgaactggggcgagagctctaaattcgtcacggagtccgtcggtatgatcgtcaaagtgacgtacaccagcctggaggacggaacgttcttcctgggccggcggtacccagcacccacgaagactctggcatcatacgccgacgttatcaaagcgattgccaagctctcagtagctcgcaattccgacgtcgacaagtatgtgctgaagctgcgtgggtattggacgaccgactcgaaaacgccaggcattggcgagtttctcactgctgtatcaaagatctacgagatcaaactggacatgttcgagatatgtgacgtcgacgagtttggcaagcccatgctcaccgaagagatgtcatcattgctggtcaatgaccgggacatgttccaccgcgtcgtaaacgggccttacgaggtcgaagacgcggacgtgcccattatgctggagagcgtctcccgcgagcttggtttcggcaactccgctgagtgccaggactggctccgggggctggccggctgctggacatgggatcagcttgatgagtacttgcttcctggcaagccgttcgaccccgacgacgagcctgagggcactcgccgggtgtcgggcgcactcgagacattgctggaggccaatgacaagacggcctttgaagagaggcttcgtgcagaactcaaggcggcgctcccatcggagcacgacccgcaacccgagcctgcacctacgcctggcgaactgatcaccagcgaactggtcaccagcgcagcgctggcgctggagtacctgcttcacgaacgcaagactcggaagcagggcgcagcacaagccgacaagacgtcgcaagaccctggtccatcgtccgctggcggcggtgaccaggctcatgcatgagcatagctcatgcaccactggctccatttacgtgtttaacaacgttccggcacgtactacggttaggtttggaatccaaatccgtagcctatggttaggtctgacccaccgaaatccaacgagcgaacgctcggtgctcaattcgtacgtcaagtacacagggcattgagtgtggtacaatctgttgggtgaatcatgacgacgatgacacctcagcaactagtgcaggccgtgcggtccaaggaccccatgcacggcctgtgcgaatccaagcagatctcccccgagggctgcgattggctcaagttcgcactggaccccttccatgacttgcagttggacaacctccgtggctaccctgatgtggccacggagccgacggtcatcgtgaaggtgcgccaggcgatagaggtctcggctccagcggcagttagggctgccaatgagaactgggattgccacatcgcactctccccaattgactgggccaagcccaccggcaaggtggccggcaacaatggcgatgaaggatacaacgtcattggtcggtattggcccatgggtgacgggactgggttcggcgcagctggcctcattcgtaatgcaggcaacaccggcgcccaaccctcgacgcttgggcgggtcgatggcttagtcatcaattccgtcccggcggcgccatcaaatggcggggatctgacatttactcctggacacatgccgcttgttgaagacgcgagtggacacaaggttgaccagatcaaccttgacgactatctcgatttcgacgcgtccgacctcggatcgtatcggatcgtctacagcggcttcgaggtggtgaacaccactgcccagatttataagcagggcgcagtgaccgtctacgagtacgggcactcgtttgagacgtcgcaagccctgtcttactgggacagcaacatcggtgcaaccccacccgtggtcaacaaccaaacagttggcacgaacaccttccggtgccctccgaataagatcgcggaggccaagatcatgccaggttcgcacacctggccagcacaggacgggtgctactgcactgcaaagtttcagaccgacaacccattccagtgcccaacacagcggaattacgtcatcgcgcaaaacaacgcgaccgctggcactgaatcggggtacaactcgttctcaggatcgaacagtggggggtcaattctctcccccggcttgattggcaacgcgtaccaaactgtgtcccaggcggcgcccggcgccgtcgaagacgcagcatacaacgtggctccggccacgcacttctcgcgtatgtccactgcaggcgcctattttacaggcttgtctccccaatccaccttgtttgttacttggagggtggggattgagcgcctgccggccgccaacaagccaacgttcctggcgctcgcccagccgagcgcaacatacgatccaaacgcactcgcactgtacaatctgatcgccaacaaccttccgccggggtgcccacaaggctggaacgatttgggccgctggttccgcactattgcggacgtggcccagaccgtcattccagcagcattcccgttggtcggcacggcgcaaatgattcttcgctccatgggcgcagtcaagggggccgcggcattgcccgcgatcgcccaggccgccatggccggagtcaatgctgccaagcagcgcggtcaggcagccaacaaggctgccatcaaggtgcaaacagccgttcggaacaagaagaagcagcaaaggggcgccgttcagaatttcggcaccccgggtcaacgcggatcaggcagggtacagagcttttcacagatggcttaggctcagactggtctgcacatcagcaggttaccatcacctgcgacaagttgcgcgctttcattagcgcaacaactcatttactgcgacgttttggtcagcgtcataagaaaatggaacacacaacacgtcggggatgaaccccaccggtacacttagccggtccaatgtggacggacaccaccccaagtttcgggcgggacgtgtgcccatggtcgagattactcccatgagcgccttaagcgtaggttataacgctttagaaacacc

SEQ ID NO: 505 - DNA, 2380 bp, Unknown
  derived from dsRNAs of unknown virus
gaagaaaacaactgcaaggtacttccagattgccaacaaaacatggacgttcaggaggccatttacaacgtttcaaaacaaaccaaaattcacacaaccggcggacttggtgtcgattgtgatgaccttggttacgttagcattcgcactctagacggggtcgaatgtgtccgactgtgccacaccggcgcagatctgcctgtcaacatgtggatgccacagcagcggctcctcctcacaatcgaggtcgatggcggcgtcgttaaggtcttttcgacctcgacgactcttccagcactcgatcagctgagtgaggagatcggcttcttcttggctgaaacctcagatgcgggcttcaacgtgctctcgcgtggtacgtttcttcgtactaagcgatcgtgtacggtacacgttcggaactctgtcgacgtcattcgtctcgatccatcaggatacggacccctgcagtggaagcactttctctcgtgtccaatccagcaatctgctggtgaggtcatcacgatcgatcgtcaccacgacaggatgaagttcccaaatttcagtcttgacctcagcacgcaaatcgacatgttcaacttgaacaacgcgaacatcatgaaccgcgggaacgcgcctctcaccgaggccgagctcgcgttttacgcgaagctgctgtccaaggttgatcaaagattgatccagcaaatcgcactgcttggcaagatggatgctctggaagctaagaaggtctgtggccgcttccaaactcacgtcggatcgtttgatttccatgccctgggcatgttcatcgccgatttcttcgcaaacttggaggctcccgtcaccgttgagagctacaccacctacctcgctggatggtggctcaagacgttcgagcttgaacccaaaaaggctgaaggtgagccaacaggagcgatgcgcttcttccggtgtctccacaccacactgacgtcttaccatcgtgatctcgcgcacgctctcactgagctcaagaaccatatggtggatccggaatcgagtactcctgtcgtaatcattgacatcaatggtgaagagtacacgaacgaagagattcaggagaagctcggagcggcctacgagtcttttgttctcgtcgcaggtgacgaggaatcgcacctggtcggctactcaggcgatgacctcaagggtggcattgccattctcgaggaacgtttgtctagcaccgaggaacgactcaacgctgttcgtgcttctccactttcgtcgtggagcaaaggtccgccgaagcagatggttcgcgatcatgtcgaagctgttgtggctccgactgttgaagcagcgcctgctccagccatggaggcatcgaagaagaaggcggaacccgcgaaagtggagaaagccaagcctaaggctgctgcgaagccaccgaaggaggtcacacctcctcctgaggctggcccagctgaacctactcgtgatgagactgctgctgctttggcgaagtcgattcgtgaccttctcgatgccagcgacggtcctatgaccgctaatgagatcgcgaaggctctgggatacacttcggcgaaacctatcaaccagatcgtgactaaggatcaaacgctcttcaggtcgaagcgaggcagcaagtatgcctacacgaccgagaaggctgaagaccctgttgcggacgatgagttgccgaaggaagctctcccaccggtaaaggttcaaccagccacaccaaaggctaagtcgaaaggactgtcgaaaaccgcactgtcacgcgccgcgaaacaggcgctcgaacaattcaagggtaagcaatttgcgtttaccaaggaaggcgagcctctggacgatcccatcgccgtccgtgatgcgaataatctcgtgattgaggttgaacaggccgttcacgccactacgaacgagacgcaaggtggcaagccgattggccgcaccttgactttcgtccatggtgatcagcgtttcacaccacgagttgtctttggttcagatgatgcttcacatgtattggttgagtttgctagcgaggccgccggtccgaaaatgaccgctggactcatgctcaattcacccgacgacgacagacacgcttccaacaccacgagcatccatgttacctacgagtcgcagaccgtcacgacagccatcgtcaaagctggcacgtcgttgctcaaacggttctacggcaagatgatcgctgattcactcgaggatgagggtgacgaatggcatcaggcatgggagccggacattgcgtacgaacagatcgcaggagacgccacggcggcgttgacgatcgtttcggaccattccgcataagtgcgcgccttgcaactgcatttaaactatc

SEQ ID NO: 506 - DNA, 3580 bp, Unknown
  derived from dsRNAs of unknown virus
gtttaaaaaatcaacatcggtgggtgttcgaactcatttttctaattgaaaaaagataaacatgtaaccatttgtataaaatttgtatagaattgtatgcattcgaattgtatgtaccacgtatacgtataacggaattgtatatactcaaagtgtatatgtcacatgtgtctgaatctacacggatatctatacggatttttattattacagtgattattatagtgattattgtttacaacacgtcagacgaattgaatgaactagtcaatcacgttcgcgaacgacaacaattagtttcttgaaatcagtaagtagattaacggttaatagtcagtgtgatcgttacgtcagctcagttaagttatgatgtcgaggaacgattgtgtaatacttatactgttggtagtcatttggacggtgtggaattcgccagtgatatatgcacgaagtttaacttcgatgagagacgatgtagacgctggtgatgacgcgttgtttcatggcatcactgcattggattgtacttcaaacatgactacgttgcaacattttgcagcagacgcgatcaagccgtgccctgattctacgtctacggtctcgttcgatgacattagcgttcaggtgctacaattgaaaagagtggtggatgtaaatatgtttcgttgcgaggtacatgtgaaaactcgttatatgcattgtggcgacttatctgatacgtcagagctaccgcatctgggtccacagggatacataccacgacatgtttcaactgaagattgtagacgtatgcaccgtgaaggtaaatatgaggcgtggaaaggacatactctatcggggatcaagccaggtgtagggatggtgaaagaacgttacgtagtcggctcgtctgacaatgaagggtggtgccacaatggtattgtttatcccccttacggtaaggcgcaatcagcgatgcagcatgaggagattagagtcatgataacgacgggcactgcgagtgcgtcaaaggttgacagtaacggagaacgaatcgttggatatcgcggaatgaaatgtaagaccgcggatacatcatgctatgatttcgagatgggacgtttgtattgggaggtggcagatgatacctgttcacgtgaagtaatggaactgtacaaaggcgatgcacgattgttaacaggagatgacggagtgcaggctattaggatatcagacgaagtcaatgatttccaattttatgcgacgctgactgcaaacacttctacttgtggggtgcgtgtatggcaaacggaatatccagatctacaggtcgttaagttgacaccgggaggtgatttcatgcgtaacgtggcacgcaaatcatcatcagcattggatttaacattgtatttacacgctaagctggggctgataacgcatctggcggatgataacgacttaatgctgtatcgacaaatgcgcagacgtgactgcgaacgaaagcgtgatatccttcaaatgaaagtggatttaatgatgtctcaacctgacaaactgcataagtggggaaatgacggagctctcgcgaaggtacttggtgaggcactgtacatagtcacgtgtcccaaagttggtgtagtgatgcgtaagactgacgcgacgtcttgtcagcatgaattaccgataacgtatgatggcaagccactgtacctaacccctgtcaccagagtaatcaccaatgagcatacaggcatggtttgtagtcctttactgtttacgtcattccatattggcacacagtggtttactcctggaacgcgtcacgccattcccgcgcctttaccattaacagttgatgatgatgcttcagggaaaccgcataccatgagttactttgcaaagaagggaatatattcacaagaggagatcaagcgcaccaaagacgaacttatttggcgatggcgtttggcatcgatcgcgaatgtttaagattcgagattcaatagaatcgttgggcttggggttagcatgtgaagttgatgccagtggcctggattcatgtttgagactgatggcgacgtatcccgacatgccgccgctccttcgtcacatgttagtgattttttatctacgtccgaataataaaaatcgagatttgatggacaagttggggaaactatcagcaacggaattcgtggatgcagcagagccactgagtggattcatacgtatggaagcactttccatggatgatggggcaggtgtattgtgggctgatccatgtgagaatggtcgtcttgaagggtttgccactgacgggaaaagtttccgtgatgcaataaaaaagaaaagtagtaatacgatctcactcgtggtggttttccgatacggtgtagaccatgtctataacgtcggcggtcgctccgcacaacaaataacattgggatcaccatttatggagatgcatgttccccgcacttaccacgccgcttttctccgattgcaacgcggttatgcatgtattaaacgttgtgcaagtagagacaaagaattggcagtacgtactcacgtccgtcggctattcgagtatccgttccctgatggagtacgaattgttgagagggcgctggctgatgtcactaaattcttgaggggtcacgttgtaatgcaagatggtaaggccagtttccactattatgagtgtctacttgcggccggcaatacggacgaagctaacctcgggcaatttatgactgaagcattacgttgtgcttttagacactccggtaagtacaaagatatgggtatatgtccgtctagtcgcaccagcattacattataccagcgtggcaccgtattactatcggacgtactgtcatatggaaccgcaaccgccacaggtgtggtcgcacccgcccctgtgactaatggtaccgtagtgaccacgtcgggacaagcctccactgtctcgaacggaaagatacgtccatgggtacgaacaacacagcaaactgatttggcgaaacatcttgcgggcgttagtgacgggcaggtgaagaagagtgctgaagcgaacgacaatgtgaattcatcacaacaaactggtttgacaaaacatcttacgggcgttaataacgagcaagtggtgaagagtgttgaaatgaatggcaatgtggacgtaacctcaagtccattggctactgatactgccgcatccatagctccctcaccctctgaaactgtgtcacagtatgcgacacgggtgtacgacgcagcaccgcccacggatgatgacaaacttaagcccattcttgtgcgcctttggtctgagttaccagcaagaggtcggacgaaactcgttagcaagctgacagatcaacaactgatggacacaggtacctacgtctacacgaacattttaccgaatgagataaagtctgccatcatgtatgcggtggtaaacgaacaaagtgcacgcgaaacacaacaacagaaatcagagcaataatgatatagggtcgacatgaaaggtctagcgagccagcaggagctgtgctctcttcccggattccaaccgacgcgttaactcgtgaaactgacc

SEQ ID NO: 507 - DNA, 3442 bp, Unknown
  derived from dsRNAs of unknown virus
gaatatcattggtagaatctttaaaaacagatgtcaaacgtaaccgaaaaatataaaggtaaactcccacgccctgctaaggaccaaagcgtcaaagagttcgaagaagaggaaattaagccagatgccgaatacactgaatttaacagcgtgaaggatatcttggccaaacccgattatttcgagccaatcattaataccccagaattcatgagtatgctggagaaggaaggaattacgattccgaccttttccgcacagcccaaagaggcaaaggtagatgatgacaaaaaggaaaaggtgattaagcaggaagaggaacctaaagaatcgatgaagaacactgacgaagaggaacccaaggcatcaattgatgtcgtaatggtaccttcattggaggaaatttcacccaccgatacgatgagcccggttgaggaaatgccatctaaagctcatttcgagccggtataccgtaggatcgtgcacccattaaccaaaccggtatcttttgatgttacgcatggtttggcgacactgaataacacaggtcttgaggacatgtacatcgattacagtggtgacagaacttccaaaaagggccgtgtcctcttcagatggctgcagacgtacagacctatgagtagagtggagtcgattaagtacgactcctccaccggcctggtggatttctcaaatcatagtcatgtctttacttccgacgttgcgggtaacagcgcgacgtctcatgcgtatgaagtcagtaccttgcggccgaaagtggaagtggcacaaccaggcttcagagcgaacgtatttgctgatgccacgatacccgatgtggtaacgtcgcagattgatggacgtgttatcgacttatcgatttcctcacgccccattggttcccgaatcaagtctgcggacgtgattatgaacccatggcgggcaccaatcatgctccgtgacatggctgcgtataattacatgactttatccttcaatgattggaaagatgtccatgtcgattatataaatcagggaatgctgaggtatgttcgtgagcgtaatgctaaagaacgagatgtaattactaacacaacgctccagaagacggcgtatgataggtacatcattggaagcgctggtgcaaatagcgtcacgtactattacgaaacgataccaagctacgcgcccgttctgtgtgaatccgttcttggcagatccttcagtaaagcgagtgaagccatgtctacgatcgcgccttcgcagcgctcgatatcgacaaacatcacgaacaggcaggcgtcaagcatgctactaaacctgactgcggtgcaacctagtgctggagcgaacttgatgcgcgatctcggtgcttacttgcttggtggcaggcgtcacgtgctggaagttgatgtggacgacggagctacaaaaacgccattgctaaatgctttgagcagcatggcatccttgatcgtgcttgacaggcgattcctggacgaaaggagcaaacggcagctacttgtgaatgtgctacttcctttctatgatgagtttcctacaaggcgaaacaacgtaagagatgtttctagaagcgttcatgaaatcgctgatgacttcttagcgaatgcagctacggctatcctcccggacgtcacaaaaatggtggatcttgctggacgcggtagagcaaaggggcgcgaaatcaaaatgatactgcaagacctgctaagaaacgttatggtgattaagttcgaacagctcggtgaaacggacaacatgttcaaaactggtgctgctcgtccatacatgcccttttcctcacgagatgatattaccgacattgtactctttggtacgcgaactgacggtgatgaatcacgcatgcatgaaatggcatcgtatcgaccgggtgctataagaatggcaaacgctctcgagagattctcggacgttcttggacgtcttagacaattcgatggtcttggcctggctgttagtgaggcgatgaaaaccagttcacacctacctgcgtccatggcgattttcactgacgctttcgtgcacggatcagttcatactgatctgctgtcggcaactactcaggtaagatatgagaggtccgttggatcgatcgtccttccctttgatggcgctctttcattcctcctgtacgggatcggatcttcagagatgtcgacaagtaatgactccttcgtcagattcaaatcgttagcatcacctacgatgccttcattgtatccggcatacctgtactttgagagatcaattgtgggtagtgcttacgctgcattcaaagacgacctcctcatcacccacttcgacatggtcgtaagtgtgtgcctagacgccctaaaagtgtatttcaacgccgttgatcctgaatcagcgagccgtatctcatacctgttcgatgagagggagacattggaaaaccaaaacttggagcttcctgcgtctctgacatcatcgattttctcaacgcatcaatacatgccaaaaatgggagctaacggaccacaaaaactacctggatcgtttgagactaatgaacaaatacatgagtcaaatggcatggtgaacccctacaaggattcacttgacgcagctgataagataataactaagatgtacattgatttcaagcctcttgtcccaattgatattgagacgtacaaccagggcaccactctcgtttacaccaagccaagccatgatgatgcgcgttatttaagcctaaaggaaatagtcaaagaggcgaggtacattgattccttagaattaagcattgatggtatcaagaacatggctatcgcccaccttaggaggatggaaaacgacgaggagattgcaatgtatgacggcgtcatgatcgacactttgatgactacttttaaattcgttgagcataagggtctaagtgatttaatcgtggacacaccaaagatcaaaattgataggaaccctcgtatgctcgacactgacttcgaagtgtccgaagtgtcaatttattatcatcgtgtaactgataggcagggtgacttgagcaacccagcgaaacgtcgagagcttgattatttgaacggcttccttacttacgtgagtgtgagcaagaaggaaatccagaaaagtttgattaacttcgatcacatagatccgatggatccgtcaatctataaagttatcaggaaccaaaacgaaaatgtccgccttgaaccgaacgcgctttctagcgtccgaattagagatgggcgtggaattacctatgccggtactatgactctgtctactagagaatccgaggaaattggaattaccacatcacttaacccaaaggaagagttttgaggtagcaccatgcactcatgggaaatgatttttaaagtaaaaagtattctatacggaaccaatgtgaaacatc

SEQ ID NO: 508 - DNA, 13160 bp, Unknown
  derived from dsRNAs of unknown virus
agaaagcacaatgttgatgcgacgagaataattgaagaattattcattttaaatctttaattatttcattgcattttacatttactttcggacctcagttaaagttactagtttactttattttagaaatagataagtcaattgtttttaatatcttcgcgataatttatttactcaattagatagaaacttcttttgaagctattgaattctgaggactgagagtgaacaaacattgtaaacttgttcggacatagacacgggagtgtttattaaaagctggacaagcattatgtttttctctacatgggacttgaattggatgcgaaaagctgtcgagagtcaaattgcttataaacgagcggtagactttttcacgacttcttcgtgtcttttggctcataaagattctaaaaacatttttaaaaaaggttataacgttgacaatcacgattttaacaactatagtaaaccgaacattggagacaggaaaaacaagacaaagtcaatacgtaaaataggtatttgcttaaatggaccttctccgtactttgtgagtaaggtaggagtttgtcgaagttttgatagggttaaagacatgaccaaagacttaaagaaacgcagaagctggaaagcttttactgctagagctcaagtatctaagttgagatgtgcagttgttttcacttcaggaaaacatgtgcattattctttatttgatgataatcagaagcgtagaggaaaagggaaagacttcaagaaaaagaagggaaagattgaggaaaatcaaattgaagaatatgatgaatgggagaaagcaaatcttatcaatccttgtaatgtatctaacaataaaaaacctacctccagcaattgtgaggactcaatttcacctacatgggtccgtgaagagagtcgaagttcagaacttaaggaagacactttgagtaaagagactgataataaagactatcgaagtttatcccataaatttcatgacattgtaagctttagaagaagtaataagatacatgaagtttccgaacgagctaaactatatgataaatctaagcacctcaaatcacaagattttgatgataatttctgttcgttactgaatgttcctgaaaattgtaagattaaaggtttacttatcagtgagcttgatgaaggaacttctgattgcttgaaagattatgtagaaataagcaaaatcacactaaactcaattaaaatgggtgatgaatgtgatgtacttattcttgaaggacatgaactctctgataatctagcttgcgctagtttgttctcttttgctggcagttgtgggtgtgactcgataattgttacaggagaacataaaattcacgacagtttatcagagtttttgcggggcactattattaaaaatggcaaagtgtttagtgtgtacagcgttgcaattgccagaaataatttgaaagaagttagtcatgtgttagttaggacatctgttagattcatatcttttagttcattttggatacttatcaataagttgtacttgggacattcattatctttgtatttattcgacatacttactgtatgtaaaaaaaaaatttgcaataacgtaatgaattattctagatcaattttgtcaaatttcgtaacgcttgaatctgagattactgatttagctgatcttaaatatattcaatctataagtgatagggagaatttcatgtcttttgttgtcgattgttccggtgaagctggtacagcttttttacataacaacataattattactgcattccatgttaccaaaggtaaaagtattagaattggtagtaagaaactgatatgtttagacaaggatgaagaacgtgatatatgtttttatcttacgaggccagaagattctttgtttcacattccaataccaggagctcaagtttattgccaacgaggcggtgacgttattaagggttatgtgagtagagtatttcccctgcaaattgaatttcctggttcacctctccatggttggtcgggttcacctatttactgtggaacaaatcacgacttagtgggtatttactcggttcatatagatgtccgtgaaaaaggacgccatttgtgtatacaatctaataaatcgtggactgatcaggttttaggaaaacttgagaaacacaaaaggattcaaattgccgtaccttgcggaacaggtaaatcttcactcttgatgcaagtgattagcaactcaggaaaatataaaaacatattactgattgaaccacgagttgctctagtacaaagtataggtaaaagaataggatggaaaagttacgtgggagatgcaccatgggattgttgtgatagtagaactatcactacacatggaaaagcgttttcaaagataattaattgtgaagggttcctagatggatacgatctcattattatggatgaagctcatgacggtgatcctatcagcctttgtataatgaaatatttatgcaaaatgcggaaaggtccttctttagctatgacagctacgccaaaaaatagtgattttcttaaggtttcacttttgtactctaaacacgtaagaaatattagtgtgatgaaaaaaaatcttaaggcagaagagtataaagatttaatgaaaaatcataagaaaatattatttcagatttccactaaggcacaagcactagaagttatgaattatgctacatcaaatgggaaaaaatttatcagattcatgagagaagacgtagatgaaacaggagccacacagttagctaaagaaattgaatcatataaagaatgcgtaatagctggatctaatgttgttgcatatggtgtaactctcgacattgattgtgtagttatttcaaattgtaatttatcgattgactgtgaactcggagaagtatctagattggtagaaactaacctttcttgtcaggatcttgttcaatgggcaggcagagttgccagaacgcgaactggtgaagttataatatatcatagcgtccttggggctagtgaaaaatctgttgatgctgaacttaaacttcaagttttctggaagtatataacgagaaaagaagttaaaattggaaccaatctgatacaatcaagcagagttcctttacttctttctctcccctttacattagttggaaatttatctgttactagtgaagagggttcaataataggaaattgtaaagaggcagatgaaatagctaataagttatctcttaaagctgtaaaccctgacacaattgttactaaaattgtacaagagggaacatcattatattacagaggaaataattatggacttgacaaatcaataccactaccctggttaacattattgggaataggtgagaaaatcgatataaatggtaagtcatgcgaggagggaactgaaagtcaacacatacctgaaggactatctgctagaagaggttatttaagtgagtattcagtagacaatacttctatgagttttttaatgtggttaagattaattgccattctcttagcagctatcctcagctattttcttcctaaaattagtatgacttctatggaagagttgatgtacgttgatccagctgatctgcatattgaacaagagcaaactggcagttctggagccgattttcctccatttattatcagtgaattgacttgtgacacatcaataaaagaaagctcagtgtacttcgataatacaggtttatttcataaaccgtttgggtataatgcaggaattttaaaaaggaaacagtttgaaataattgatagagatcttgaaactaaatttaatactgaaacaactgttttattaggactagttgagacattaatcaaaataattatatcattactatgtacgttaacattcagcaaattattcaaacattgcccttcactgttttcattagtctccaaaggagaagagcaaggtcgacgttctagagccactagtggtaactttataacacatttcaataaattaatatacacttctgaagagtcagttttgcggttgttaatggagttattccaggaaatattaatgactattagaatgtcagtgaatgaaaactatgtattaattaaaacaaaactagttcccatcgcatatcagtttatggagaatttaatcattatgatacaaaactttagacaatttctgatagcaatattagtcaaaagcaactcttatttgcgtaacatgaagcacaagcaaacaaacatagaagttaaagtggaacaagtatttattcatgatgttttgactgaaacaccttactctcaggaagttggaaaatacattaaggagagtgactacaataatttcactgaagtgaataagaaagaaattactgatagaataaatgcttatgctgaacgtgaaagaggaaaactaaacaagcaagacaacaacactattagcgtagtgaaaggattcactgatttgttcatgatagcacaaatagtttggttctatgtaatgagttcaatgttaacttttgttacaatttcgctggttggaaaaacaacgtatagtaaaatacataattcccaaggtaaagcttgcgaaagtgaagctgaggctgttagtaatatcacatatgaaatcgataatgtctttgaacatattgtcacaggattcttaaattttgctattggcattttttttttgccgaagtatgcatcgggtacatttgtcagtattttgttgagtgaagtatttgaaaccctttggagagttgatattggtggaggtgatactataatttctatgatctcttcttctttacgtaactttgctgaaaagtttgactctcttgatgctataattaacgaggaggagaaaataagtgctattaaaaattactggataagatttactgtagatgcagctacaaaacttatttattatttatccactggtcagtataatattatagctctagcatgtcatcttgatttgcccttcaccttcgtcattttgcagagtggtttaataaatagtagaattttattataccatacagccgcttcgactagttatgctgtgaataaatgcatacaaaatgaaaagagaacgttcctttcacttgaaaagatgcctgtactacgccacatactttctacattgtgtgaagggaggattcctaacaacaaagggaaatataaatacattggcaataagatgtacacaattatgaggatgccgtttagctgccttttatatattgcttccgatttgtcatatgatatagttattaaattacaatcttcacaaatgttcagtagtttttggtatagtttctcttactacagccagatgattttcaaaactaagtttccatccttcaagaacggttacctttatgagaaaattaataatgacatggtaaatgaagatggagcaagtataaacatggaaggagattcattcgaatctttaggtgaagagagtaatgataagatgaaagccataattattaacaaaatcccttcagatacaatggaagtaagtactatcattcctgaaaattcaaaagataacaaagattgggaagaaaattttgagaatgaaataaatgaatcagaaagtgtcagtataaataaaaatctgagtgttgaagagcaaagagaacagctaaagaacaatgaaaccctcaacactagctctttagagattatcataataatgttacttatcgtaagcattactctctgctttattttgttatgggggagaatggaggaaattgttatcagatctacagtcacaatggaaaatcgcatccaagagggaattgctgtaatcaatgttgtatcaaatcaaactcttacattttataataacgtagttgttttggtacataaatttattaggatgataagtttttgtttaattccgattattattatactaacatatcatgcctatgatagaataattgatttcaatgtggttaattatgtcatagagtaccttaattcaatgactaaatcttggaacatggaacatgttattttattttcttcaacgaaattccctttgtctctattagatctattctatgtcgctttaatggcatttctagtgactatcaggaatgatgttcccgaagcagatgaattcagcaatgcatgttcccctcatgagcaaagttatgagaacatgcgcaagaagagatatgaagataaatcaacttacttcattgaacaagtgtgcttagggttctgctgtttatatttccttgtaaattttattgttagcttattgtttaagtggagcctagctatattctactttcgatgccttacaagtttagtattttatttatggttcagattgttttggttttttgttttagtgaaaacattaaagataaggacggtggttcatatcttctttagagagcaaaaacatcaaatcatgaaatacatgattaaaaacggctcggatgaagaagtaataattaaaaacttttcacgatatgatttcacacaaatacacacattaataaatccggctgttggtccagcaattagggctatttgtagcttaaatgggaaagaaaaagatacttcggaaggagaacaaatgaaagatggaggtcgtaacgtaacagaaaatgttattaatgagatatcagaaataagaaatgaggaggatcttaacacagaagagacagtactaactggtcttgggtattacaactattactcttatgctgaaaatattagagctttaaagaagtataatgataaatatacagataataatttattaacatctgtttcagatagttttcgtgacttattcaatcccataaacaattttggcaaagatgaagaaggaaattactttgattgtgaagaggaatattccatatttgaaataattaaatcgtcaatttcagtgaaatcattctctaatgagttattaatgttactacgcatacgtaagaaaccaaaacctctatacaaaactttttattcttattttgtagtaggaaaacgagttggaggagatgttctaagtatgttaattaaggctttagcaggaaatggggatattgtttctgaaaaacgaatattgacaatgaatagaatgatttgcggtttaaatagctatgtaacacaagaagtttatatatttagtgctactagagcaacattgtcaagtggggctgaattattactagcttataacttctcagctctagctaaagcgtgtactaaagcatttaggagaggtgaggaaataaagtctcaagaagggagacacagtgcaaaactagcgcaagttaaagaagtttggagtttcctaaatataagtcacattttcaagataaggacgcctgactcttcatttgactacgtgaattttgctgtaatagctttcttgaatccctatgctgtaattgcctggtttatatttgacacgttattacctgaagggcgatgtgtttcaagactactcatatttgatggaatagtgagtactgatgtctttcttactatgttatggtgtattccacttttctataatgtagtatcagcacatgaggacaagaaagttaaatctgacgttatggtagctgtattcagtgctgttatgactgctgaatgctctttcttgtgtgcagcttccgacacgttcaagagatttgctatagaaacatttgaaccaagtaataatcctaacagactaccaaaaacagaagagaacttgagtacttatttagaactaccatcagtatcttctaaaaactttatgccacttcctacaggttgccttaatacaagaacaatgctggctctctcttggcatgaatgtggaattatctctaacgatgtaagggataacgtattaataattggaacaggaaaaggaggcctgttgcaaggtttagttaagcatcgaaccaactttcaagctataacttcagtaactttaaatgagaaaggttatgttcctagtaacatcttaattaagaatattgagaatactgggacaattttcacgaacagaataatgaatgaaaagaaatttgaagaaagatctttcagcttagtcatacaagatactcagttgaatacgcaaactgaatcagaattattaggtaataggctggaccgagatgtcagggaggagttcgtagaatgctgtcttaggagcatattgcgaactagaacaggaggaactactattatcataattagagctgatctatgtgatttattactgagattagttgacacatttgcttgtctattcaaaaaagttacagtcatcatggatccaattattcgaggcaatgcattcctttcgataataggtgttggaaggagaagcacgaaagacgtaattacatgccaggtttttcactgtaaaccttcatttcctagaacttttgaagaagttattaaattaagtaatgagattcgaaaacttaagaactcaataatcgacgcaagtttaattcgttccagtatgtttgagaaattgtaccgaagagaagcgttaaagttggaaaaaccaatgctatttcccgatgtaagtgaaaatgcttcttttagaatattgtcttctctagaaactcctatcgatacagatattattttcaatgaaatgcgttttttaattaagaacagatatcaaaatttagcagttgaatgtaatttagagagtgtgtttgattcataccagttttgtggtaaaatcgaagaaccagttcctgatagacaacatttaaatggactttccatgagtatcaatacatcattaaatgcagccagattattaccattagagaaaagttacagtgttcctagtcaaaccaatgaagctgtagttgcggctctcaagaaaagatttgactataaatcacaatgtattaatttggaatactttaaagatgctttaaaagcagtgactgaacattgcgtggaaagagcccgtggctttgattttagtgtaacatcatgggaggacttaagggaaaatgctaatcttaaatcaacattaggttttatgtctgatttcaaaggtgtgtacaaaaacataggtgagatactacgtgatggtacatcgcacttagactcttatttggaaactgctataaatagtccggaagatttaaaccacctttttcatgcttcacctaaagtagaaaagaaagaaatcagcagagaagctactattcctcgactatttacgtacaagacaggagaagttagaatgtgcgaaatggccatttttcaaaaactgaatgagtttctcgggaaaagcaaaaaaatatcattttcagcttctggtgacatatttgatagagtgtatcgcctaaataataaatctaaacaatttattaaaccatctttcatcgaaattgagtcagcaaagtttgatggacataaagaatttgaatggatttataaagttaggcagatgatggttaaaatattactttctggatacaatggaaatacggcagcaaaatactgtatggaaacattagtgaatgatggttttggattcttaattttgtgtagtggtcatattatacaaatgaaacgaggtaaccagaaaagtggcttatgggacactagcactaataataaattgactaatgcagctatcttagttaaactagtgtctgtggctctaaatattgaatgctatgaagttttcagcagagtagaattcgaagtagaaggcgatgatgctattataatatctgaagaagaggatggtaggaaaattttggccatgagaaatgaaatctattcattagctgggtttcctcaaacaggagatcctatcctacaaacagatataagactatctaaattttgcagtcatggagtaggtttcactagcccttacaacattcctattcctataagaccggccaatgaaatatttggacgagcccagtgttctttagctagtagtagtttaacttgttcatatgagaacatggctagatctttaagtactgttatatcttatagtgcaatgttctgggcagttcctgaaataaggaagttgctcgaattagtgaaaacaataacgcctaaagacgtttatcctagaagtgttcatcctagtgagaaatggaaaatcgttaattggtttggtgatttagacattaaaacatttgatctgaatacatgggtttatgataaatttggaattgatctacagtacacttatgttgacgtagataaaactacaagaaaactcatgggttttgatggattcagtgatattttactcatcaaggcagaaagaatgaagcaacttgttttggacaatgtaaactttgaggagatccgccaagtcactgaagcatatttaggaactatagccacagaagaagatgttagaagagaagctgaatactttaaaaatcatccaactttttctattctaacaactagaactagattgcaaatcattagtgccctaagaacaggcattgaattttcaggaattcattgtatggtaggttcattaattaacagaataacaaaaacagtagcttctagatttatagttcacgttgatactcttagtagagaggaaacagttttgtgtgataatataatggaaaaaaaaaaactaagatcactaggtatgtcaggcgttacagttattctgtacaccaaagacaatcaaaaagtaatacaaacttctaatgcctctgacttgctaaaactcattctgaacatgatcttttcagtcgtagccttcttattcctaataaaatatctttggggaatgaaaaagcaacaagaggtggatggaaatattgatgatgaatttgacttggttatgaaaacgtcagataaatcaaatggaaaaggcaggcctatttcaaacagaccatggtttgctataactaatgcacatggatccgtcatgactcggctaagagaagtagatataaaatgtaagtacaaaatggcaaagggtaggaagaagaatggtttaacactgttcttagctatgtatcatttaatctctagaagaggttcattccttgatgaatcaaatgctcttcgtaaagatttagaagagatcatgataaatgaacgcagattgtcaatagttcatagtaataatcctcataagaatcaagatagcgtcatggagattgtatataacaaccaattcagaaatagagtagaatcaatcgataatggaaactttattaatgaagtgaatgaagtcgttagcaataatcagattttagcagaaagaagacaattacctccaaaaaattggaccattaacgggaatatgatcactaccaattcgtggagtggttcagtccagtacggtcaagtggcaaggcttggagaactaatacccactatcaaatgttatgaaggagaatgtttaatgagaatttcagacacaccgatggcagcactagatggaagctctcctaatgaatatttgtttaaattacaaaaagaatttaatgctagaccaacgaaaggttatttgataatgggagaatcaacaggtcacaaattcagagatgtgcccagaccatttggatgtgatgttagctcatcacttaaatcaattaagtggaaagaagtgagtctaagtgagaaagagaaaacactattctttagaggtggtcctacaggtccaggatttcatgctgatgacaatataagactcaagataataaaagaaacacaaagaatggaagttattcctggaacgagtgttaaactagacctaggctttaacaggaatcataacagaataagaagaggtccatctggtaaagtaggagtaacagaacatatggaacttaaatcagctgttgaaaaagaagaatggtccagatttaagtatttgttagtaatggaagggaatgaagctcctgatagaatattaacggctatgaggagcggttctgtagtaatacttgttgaacctacatttattttgagtggcataacatggtacgaacctttattgaaacacagaacgaacgtaatgatagttaagggtgataaagaagaaatttttgacattgttaaagagttagaaaactcagaagaattatacaactcaataagtactgaaggaaagaaactggctatttcacttttgaagatagaaattcaaaaagattatgtctcaaatttaatgtacattagcaaattaatgggaaatattaacgctcaaaaaagagaaaatccgaactctttttctgttgaaaatgtgaacggttgtcgctcaacaaatagtcatttagattcatcatcaacaagagccttcataacgaatagtggaccaaggagaacattattaaccacaattttaattatgcgtgaagacaataacgtgatctatgaaaaggcacttcttcttgataaagcgcgtaaattattcacagaagctttttctactattattcttaaagggatatcaagaactatagatagagtattgcttggaaaaatgatatttgagacaatatttgtaaatgttgaatgcgagaagtatcacagtctagagaatggtaataaagttttaaagagcacttgcaatatagaagcgattttcaaagtattcaaaacgttcaataaattattcaagatttcccaaacagatatgatggaaaacatgataaacacaagatcgtttatagataataatgaacttgtgtcaagtgctttttttttgtactctaatatcacaggacgagaaaagattaggaaagatgagtacgcacaagtctcaactgctgttacaggagaaatgatgtatacaggtttgtatggtcaacaggttttcgttaagtgtaataaagaattattatggttagaaaaaaatgaagaattttcatgcatagtaatgaatgaactagatagtgttgagatgatcagaaaatcaagagttaactctcccttttatgtacgaattggatgattaagggagtaagaaaagagattgcacctcttaaaagagcaaacagaaagaaactgtaaatatcaaatatcttaataaagataatgaatttaagaaattcgacccctgggaagggaaaaatatagaagataatcttctttaaaaaatacaaataaacaac

SEQ ID NO: 509 - DNA, 1773 bp, Unknown
  derived from dsRNAs of unknown virus
ggtttaaaaattcattccacaccagtatctgcattcgcgatgtcaagaccaccaagatatttgtttgttgttgtcatgccttcgctctgtggtaaaagcacattagctcgtgatcatcctgatgtgtttttggatatcgatgaattttatggcgatttgagaatgcgcgatttgcttatggctaaaagatttcaatttgatgatgagacgcatgatcgagacacacgtgtgatgcgacgaattgctctaaagtgtgatggatctaaaattctattagtgcatgctgaggttcagttggaacggattcaacgcacattgaatgaaatccatgttggcggcgtcaagggatattggccacattatagtaaggatcgtgaacgtatttggaatacggaagaacaagctgatttaccagcaagtgggacgggagtggcccagggggatgagctctttggccacgtcccgttgcatgtgataaatgcgggcacgtaccatctgaacctctgtgctttgggaagacgtatttggtcgttgcaccacacggtttgttgtaactatgatacggaactgaataagttgatgaagatgcatagactctgtgttgctatcaaccatactaaagagcatttgccaaatagcgttgaattgcatactgaagttgttgctgaacaaagtgatgaaacacctgaagatgcggcctcatctatggtaagtgaaattatagatgaaattgtaaatgaaactgatacacctgcggctacacaaatcatgacttatgctcttaaggtaataagtgaaatagcacagattggcatgggtcatgagggattacggtttccgcactacactatcgttagccgtcctgactgttggagtgctatgttcgtcgaggaaaatgctatcaatatggctgatgaaaacgttaaactactatcattgttgcgctccatccgtcggatgcgaactatcagtccaggaagctgtggttgtgacggattagatggtaggtgcactgaccctcaggtttgtaactattatggactctcattctacaagtcacatgagtcacggcaattagtccggcactatgatgatttcccattgatgcattgcgatgatagcccaaatttcgcgagtcatactagaggacagccccaaagtggttctgagatacgttctgaggtacgccctgttattgctgctaatactgaccgattcccgtggcttcattgcgctggagtaatggtgttttctatcagtttttggatatgtgtaaggataattagagacttctgccgtgattcagttgctagtgtttctgagtagacgttaagatgtgtttaaaacctattgaagcgataccgttccctccggtccgacgtatacgaccgcgttttgttcgcgttcatccattacggattattcgttattcgagctgtcgttgtgacgtgatcgatgatattgattgttgctggagagaaggaatcgccagaagatggtatatgatcgcgaattctcttagatacgtgtttgattctaaatttgtcacatttactttagttaacatcggtctaatggcttggattatattatatgactatttctataacgaagagatatgataatgacgaaagtgagaaaaaatcaaatggaggtcttggcgagctggctcgagttcaacatagagccagttcgagcatcagcgatgtagtagtgtgcgtggcgcggcgtgagcgttccgcctagcgtcacggtctgtatgaatttcctacc

SEQ ID NO: 510 - DNA, 3554 bp, Unknown
  derived from dsRNAs of unknown virus
gtaaattttcctctcggaaactcctttcccctcctcaagggtcgttacaacgaaaggcacaaactaaaacaatcatttatgaaagataactctgacaacatcagtaatcttagtaaattgggtttctctactgatgaaattcaattactaacggatgctgaaaacaacaaacttgatgattccaaagccgaagagttgcatgcagcacttcgcaaaatacacaatattttaggaacattaacgatcaaacataatgaagaaatcgagaaatcaagcggcaagctaggtttcatcccaggtgttaatccaatcactaagttcgcaactagtgtagcggctgacgcacttggactagccggtaactcaccaattgaactgatggacgagggcatggctgccttaggtcgagcaggttcatcggcaattaacgctaagaccggaatgaaagtttcgcctgacgtattgacgaaaaccatgacttctcttttgaacggcgttgctgacgacgtattaacaaaaggatttactggtgctggtggtggtaactccggtggcaataccaataatccatactctcctggagctatggctgctggtactggtttcactttcatacctaaacctatggaaatcagattcacgccaaatgtacctaatactgtatatggagaagtaactgtcgcaccaaacgacgaattatcttccacttcagatcagaatattagggcaagaatgcacatgaattgtattgatttatctttaccttcatttggattcggactaaatgacgcaaatgttaatccagtaagtagaaccgttactacttggtttagaactgtctttacgcctaatttacaaactagagcgcaagcgagcgtagctttcaacatcaatgcacaaactcacttcactgctgacagattgcatacgtacgttaacacagtgcttaaagcactatctatttattacttttatgcacatacttacgcatatactgccatctctacgaataagaacactgcgatgtatgaattgcgtgaaatcttttcaacttctgatttacagaaccttcgtttattagaagagagacttaatggaatgccgattcctccgaaattgaatgaactttgttactggatgtttgatatttaccgatcaagctcagttgctggatctgatttaatcaggttagcaccttttggtatcaaaggcgcagattctggggatactgttgccactcaaattattgatggtccaacacttatcaaaactcaacttaatgctttgagtgacttaaactctgacggaacttcgaacggcagaaaagttttagttactggtgatttcttagcacgcgtttgtcctgattgggtaaacgttaaagttggttcttcagccggtattccattacatgatccagcattaactactttattctggaaccagcaagtaacttacggacaagctgatgatgtccctacttacatgccagtctttgttgataacaacacagacacggcttacaactcgtattgtgaagaattagatggtgtagtccaatctatgttctcttggtacagtgctgcttcaactagtaagtttaatgttggctgggtgaaagccattccttgtgacgttggtggccaatggacaaatcgttttacttatggtaatggtaatgcgggatttggtttctacagttacacttacacccctaatatctgggcgatgcgtaatgatacctaccgacctggtggttctacaggtactcaactgactaacattgtcggtactaaccgatgtgaagcagttccagttcttggaatgaacgttaattccgttcaagaggcaactgtctcagcactagattatttacttagtattggtcaagtagggtctaaagccccactttcttctgatattgatgacgagaaacctttaaaaggtcaacgtcgaggtagaagacgcaaataattgaatttaaattgattatgaacaaaagaattacatcccttcctttcttagatgttattaatgaacttaaccttggtaataacacttatgctaaagagaagctttctaatcttttgaccagaacaactgttggtagcaaggatattcttgtctctcctattggcaaatatggtccggataagcttttaagtgaatggcgttccatatttgaggaagcagtaaattcaggtaaggtaagtaatgaagtacttattggcatagaagatgcacaagctgataaatttagtccacgttctattgctttaccttggactaaacgtaaagctaatgttgatcagtattttatcgaaacaaacatagattactcaagtctagactgttcaactagtgcgagtgagagtttgagacctcttaactacattaatgcttccaagtttataaagaaatcaactagtgctggtttgcctagtatgagaaagaaaggtgaagtactcgaagaaaccgttaaagacattgagtactacttagatcgtgaagatcctgctgttctttatactcgaactcaagaaagcgcgaaaactagagacgtcttcggtgttcctcttgctgacgtattaaacgagatgcgttattatcgccctattcttgagttccagaagaaattaatatggcgttctgctttatcaggacccgaccgagttgctaagcatctaactgaaattattgaacgagccattagtgaaggtttgacactgatttcaatcgatttctccgcttacgacactaccataaaacaaggactacagttcaaagttggacaatattataagtcactatttcaaaagagttatcactcagaaatagataatattataagacggaagagtaccataggacttgtcacaccagatggcgttatgactggacctcatggcgaaccgtccggatctgcattcacaaatgaagatgatagtttagctcaacactgtatagcaatgtcatccaatgcaatcatagaagatcttttagatattcaaggtgatgatggcgtttatgccgttaaaccagagactgttaattcactctacaatactttcaagaagtatggtttaaatgtaaatgttgataaatcgtttgaaagtccgaactatctcgtatatctgcagaatctgtatcatcccgattttaagagggacggtgtaatcggtggagtctatcctactttcagagctttgaataggatagtttatcaagagcgatgggctaactttgaggattacggcataaaaggtaaagattattatgccattagaacacttagtattctagaaaattgtaagaatcatcctctgtttgaggagttagtcaaatttatcctttctaaggacaaatacaacctagaagtttcttctcgtggtgtcaatgaatatgttaagttcatgattgacacagagggcacagaaggactgataattaaccagtacggtgacgacctttcgggcattcgaaattggcagtcattccgtcttgttaggtctttatcaggaagctagtactctgggagttgtcgactccccccc

SEQ ID NO: 511 - DNA, 4227 bp, Unknown; identical to SEQ ID NO: 380
  derived from dsRNAs of unknown virus

SEQ ID NO: 512 - DNA, 2793 bp, Unknown
  derived from dsRNAs of unknown virus
agatttatgcaccttacgcgtatatcggtggtgtaaaagactaacaaagaatagggtagtacctatgagctacatacctgccgtgtcatttagattccaaccatggctacttcaaataggagattaattactatggaaccaatcaatttagactctaaaatctttagagcttggaatgattttaacaaggtatcaattaagaagattcctgatgctgctacttttcagaaattaatttcactctcaccaaaaattagaagttggtatcaagactggagctttaataattctgctttcagtcaaatgccttcttcttttaaggaacatggtgtgacacctgccaagtgggaggagattgcatctagacttcctgagataaatttagcacgtaaggaaagttcagcaaggattgaagttaaagctaaagagttttcagttatgattgaaaacgaacagatggctcttgctgaaaaacttgcaaaactggagaatgagtatgttaagatccttaaaattaatattacttgtttgcctattgaggatcaacttgaaatcctttccaagcctgaggaggatagggaaaacgttgaaaagataaaattagaagcacttagaacaaagcttctcaaagatttagcagatggagactttgtcgaccctttcatttttggggacttcaaggatcttctaagttaaaacatagtgaaaatgtccaaaagaaggcttatcgtttagcgaggctttggtatcgtgagaaggattcatggaagaaccaacgttatgttggctgtgagatggatgatgtttcaattggaaatattaatgctgaaagggaaaagacttgggaacgtagaaaaccattagctgaacttttcaatatgagaccagaagattacgatctttctggtgttgttaagaagattactaactacaaaccagttaacaataatggggttccttctattgagaaggaaactactttcttgaaaagaccctttaagcacgatagaccattaagctctagtgaaaggtctcaacttccactacctatcacttcatgttgtaagtgggttggtcttactgacttcccagttggaacatggatgcaaaacttcagacaaccttacggttggtttgatggtttgtctgattcaaaacacctaaatcctctgctaaaaggtaaggaggaaagacttctgtcaaggtacacccttgtctctggttcatggcaaacaaataagagtttgcttgttgatatgggaaaaccaccagctaacaaagataatgcttccgtttatgagctacttgattattctattgataggattgataagtttgggcttcctgttatttcttctaaactcccgaaatggtggttaagagcagtgactatgaatccagatgcaaatcctggagttttgacaaaacgtctatttggtgctaataagagggctgcttatggtaaagctattattgtggcaagtagaatttgggataagattgtaactagtagatctgctatatgtgataattctttgtggtctgttggtggaagagctagaaaacaagacatggcgaaaggaaaaccccctgagtctcgtattattttaatgcccgaaacacctaattcaattatagcatctgttattgctcagcctattattaaagagatgaagaaggtctcgactgcaaatcctgatgttgaatgttttatgggacatgatgtcactttaggtggatggagcagaattaaagagtttactaaggaaggaactcctacgttagaattagattgggaaaaatttgactcaactatcactgaaaacgttatagtcgcttctttttgtttactaagaactgtgtttcctgaaagccgaaagattgacaaattgtttttatttgtgatgtctggtttcgtgtataaaaatattgctatcaaacaaagatttatatacaggattacacgtggtgtgccatctggctcgcctttgacttcactaattgtaacattaagcaactgggtttgcctaaattacgttctgaggaagcaaaaactgtttggtatcgaaagtggagaagattataaattagcagtagctggagatgacactcttatagcttttgttaataataatacctttaaactagaagatgctaagcatgtttctgacaccttcaggaaagaagctaatttaaaagttgaacctgatgatttgaactttaatgaatggatgggtggtgaactatataacctagatgacattgagtattcgccaagcctacttaaaacaatgatttggcagggccttcctgggagaagattagatgacttagtaaaatcaatttcatgtccagaatcaaagatgatctcatattggtcagttcttgcgacattgaggggttatacgagtcttccaatcatgactccattaggtagagctttactaacttcattaggtgctttcgtttctgagaaatgtaggctccaagatggtgagagcgattttgatgatgtttataatcctttttcccctaacacttatttaccaaaatttgaaagtattgtcgtctcaccctgcgttagtgacaagatgaatagggacccgccctatttaactaaagataagtggaacggtttgccagacactggctggaaagcggtgttgattttcaagattgacttagatttatttggtgtctccgaatagaatataattttttccttcatatataccatacatatgatatattatatattttttaatataatatatgcatgtgcatggtatatat

SEQ ID NO: 513 - DNA, 1733 bp, Unknown
  derived from dsRNAs of unknown virus
ggtttaaaatatacgcaagtgaaacaatgcttttggtagatctattgaaccgtgttatcaacgatgcgttttccgctggaatagctgatgtactcaccgtgctggaaggtcaattctttactgtagatgatgttaccacggatgacattgaactgtttggacgtgcgatcatgggatcggctgctcgtcatgcattactcgaactaacgacggaggcaaaccgggtacgaacaacaaatgacgatgaagtgaactcgaagtggttctcaacttgtttcgatgacgttgtgatcgcagtttcaaaaggatggaaagaacgattggacttacagtttggggcgacacccacagaatgtgtccaggctatggatgattataaagagatcgttcgccgggttggaactactgtaccagcgcatcctttacagataccgcaaccaaccataggaaatcaagacttgatggatgcttggtgtcatgaccatgaccttcctcccgcgagacctggaacatgtgaatctaacttggtgtggataattaagaaggaattttcttcagacattacagaatccggagtacatatgtggatacataaacgagcagaattggcagcatcaattcgagtagcttacgcagaaaagacagctgaccacgttaagcgctggaccctgttacttatgccaattgatgacggtgctgcgaatcttgatgattatcaccgtggatacgtgactgccgtaagtgcggcggtgggtactcaacgtgttgaatttatggagcatttacgtgacagtttgactgttccgaatccgacgcccactccatacgcgccatatgtaccgatcgtactacagaacgacacatacaacgaactggtgcgcgatatgacgctcggctttgacagaacttcgatgtttgattgcataaaatgccgacctggtgggaatggacttcacagattaatgcgtcttgccctcaaccctactaacattgacgacataatatggtgcagaaccaccgccaaaactagaccactaactgggtactccgtgatacggtgtgttgagaaacggacgaatagtgctggtagagatccgcttcataatgtcgacatcagacctgtatatgtggggggaaatgatttaacgtttggaaagagccaattacgatatactgacctgtccccgggcaataaggtgttcatttctgtcaatgcgggagtgcctgaatatgttccttttacagttatggaagttcagaatgtatctcacaaatttaggaatcgtattactcggggcaggctatgtgacgtcgcaaacacgttattgcgaggttgggatgtaactgagttccggtgtcatatccaaactgggatgttgtcgttcagcttcacgggtgatgcgaaacttcaagtcatgcgaccaccgtcaccaccaccaatggcgggcggcggcatgggaggcgggagaaagaggaacatagcgaggacggatcatgaagaggattacgatgatgctgtcgatgatggaatgatgctattttgaattattgtcagaatatgatccggtgaataattgggcgagtacaaacaagaataagaatgagtgatggtaagtaacaagtatcacagtaagtgtaggtaggtaaacacatgtcatgggagaatcataaggtctaccaactgaggagtcacgtctttagcgcaagatgtgcagactcactatttactgacc

SEQ ID NO: 514 - DNA, 2616 bp, Unknown; identical to SEQ ID NO: 391
  derived from dsRNAs of unknown virus

SEQ ID NO: 515 - DNA, 2205 bp, Unknown
  derived from dsRNAs of unknown virus
gtttaaaatttataatcaaaatatacatcttagatgagtttttccccagtttcactgactgtttaggaaatttaccatttatttctttcagaggatatccgtccctctacaaacaacaagacaactgaacgttatagtatcattataacagttaggatatttaatcttattaaataaattatcatttatggctaaccaaaatgatccagtaagaaaggcacttagatctttcaaacggccttatcctccaggagcaggaaaaaggaaaagaccagcggcttttatatcgccgacttacaatcctggccgttcatctcgaccgatgtcagatccaatcaacccaaaaactaaagttcctgaaggactaaccgttgatccgaacgtgtctagacctacgaagatcgagcttaacaaacacccggaccttaaacagtatgggcactcaaaagagttcacgtcaaatagtatacttactaatcctgaaactactggtagctctttagcttcggagaaagttagtacacagacttcaactatggctgaacctaatcctacaagcgtcggaatagcaacagcaacagagactcgtgaaccagaaacaaccttaggaggtactatgatggccgtacgcggaagatttcccagcaatgaagaccatgttccaatggatagaccgtcaggcttatctagatatggaaatggcgtttacacggacgacaaaagcctgtcgtaccccgatcaactcaatcaaaatccaatttatccacaagaccccgcttcgtgggataattttcaacacgttagaattctatctactgttgtaacgatgagattctttcctcaattgtcttttagtgatgatggcaaacaatacgatgtcactcaaactaaatatttcatgaacatgttcgatgaaatgagtgtaaattaccgtgctaacaaacaagccaatagagactttgatgagcatttcactctaaacaaagtttttacttatttccacgacacaattgaactatacacggaattgtgcaacctcatggctcgccaagcttatgtagttgacaaagcaaatccgaataatccagctaataacttaacgttggaccagatatcaatatatctgaacacgacagaattttgggtattacgaaaccgaatggctaatgctctagctacgtgcgtcattccggaatatttctggaataaatacagattcatgtctcaattacatcgcatcggaccgatggagactgcaactaagcatttctttagtacaccagaaatggatactttactacgctcagctgctctatcaggaagtgattcaactaagaatgctactgtacgatcgaattacattaccaaaatgaatgcgattgtggatagagtagagtttggacgcactctctctgctcccgctctgaaacgttatgtcactggtacaactaagactaatgttttcgagagcgcgactatcgcattagacaagcgatccagaaatgctatttctgataagcttcaatattgcggacttaattttaagtcgacgggtgatttacctcctttcccttcacattcggtttacaacccgaaaatgtgtgacattattagtaacattagtgcttacgctctatttactggtgggcatggaattcacaaggcttatccgcctattcttcctaacgatgcaactaagaagccgactttagaagcgactactgcgtatacttcgatgcgacaaccatcagagcaagacgctactacgctagaaactctagcttctaaatttaaaggttgttcagcgctacatatggactatgctaaagaactcgataacgtcgatagtttcgttggtattagtgccacaaatttcagaactgctactagctatatagctgaagcacaaggtgtaactagtcaaagcaccacacagttcgctatgtatccgttaataaccgcttacgctcaaaatgcatttgcttttgttgaaagtaattttacaactaagttgttcttgagtgattccaatacaggaattaaatactcaagtaattccgatgacgggaatgttcctctatactacgcaacgtggggtggaatacaacaaagtatgtttactactaaggaaagcatgtttaagagataaatcgactagagtcgtgggtttcccagctgggagtaattggtgtttacaccatcccc

SEQ ID NO: 516 - DNA, 2158 bp, Unknown
  derived from dsRNAs of unknown virus
ggtttaaataacgttaacgttgatattgtgagtaagtaaacttaaagtaaaaatggctcaaccctatgtgacaaatggtaggttccaccttgatttgaatccgatcactgtatgtttaaacagcgcgagcttcacgacggtgagacagatgtcgccaacgatcaaacaagtttatgccaattggataacgctggatgataatgatgaatgggtgcagttaggacgcgctgtgttgatgactcccggacatcttgccttctttggagggctggaacgattgccagtgcgcatgtcaactgaagattttctactaactggacgagatgtaggacgtcggctacgacagcatttattagtggatggtgtgacatgggtgggtgcggaattggaatctgtcgatcacttgcttaacacgggcgtgtccgcaaaattaactactagtgaaccgaaaccgcctcttgcactaatggaagcggcagatgtaacgaatttcagaacggaactggctaggttacgaccagcaatagatattgatccaagtctagatgccggccaacgtaagctgcgtgctatccacgatggattgatcagccggtcatggaaaatgatccttttaatcggaggttcgccagggacatggtggcgcagtcgacttgcagtgatacgaagagatacaaagttggttgtgtgggacccccgtccctttgaaggggtacccccagaccatccaaatttaaccactgtcgactcactttgtgatgaagcgactttcctagctttttacaacaggttgcctcgtaagataaagagaaatatgttgatatctctagatattcgtcgagataaagaggaagtccgacgatctggtgctagttgggaggatgcggtcaacgccgatcaaattttgatgtgcagaatagcccaggcagcttgcagagaacgttcgtgggtgttattaaaagtgcgtccaatttacgactccgattacacaccaataatggatgctccattgctggctcagccctggatacatgaaaaatcgcatgaggcacggcagttagtccgcagcgaaacttcaatcattaacattcgtacgtcggacttcattatgcaagcatttgagtacaatgtggcacgtgaacaccaaccccttctcgatacattggtgcagaaacgatgggcatgggcgggaatagatctagtttcacgtcgatcatatctcaaggaccggcgtgctattggattgtattcgataagtaataggcagaacggaatccaggatatctgtaaatttattcgtggaggtggagtaatgaccatgcccttcgtctctttgttacggtcagagcgagatggtggcatatctgtattcgctgaaccaggacagtctgaacattacgaagaccacacgatggatgccgtcatgcaattcgagtttgaacaagcaatgattccagtgttcaacttcctggcacgtgtcgaaaccgccacacttaatcggcaatcattgactacagtaatttttgaaaagatgcgccagtaccaacagacagccagtaatccatcagcatggttagtgaagggcatatctgcagccctacggaagatacctccagcgactttatcttacgatctacgcctagacgctttcaactatccccggccaccctggtataactctaatgatctcatcggtcccggttttcgtgatcctacccgccctggaaaaaggccggtttgtgactatacggttaatggagagatacggttggtatcggggcatttgatgtacttgatgctcggcgaagcttccggaattcccgtgggaatgcgaaaatatttttctgagaaattatacaatgcgcgaacgcttgaagctggatatgaacgtggagacgatactttatggcatacagctgacgaagattggtatgcgacatatatagcggagcagttatggaaacatgttcttgaatactcaagtgtagatccaatgggtcctattgttgtgaggttctacgcttattcaagccgtgttcgccaattgatcattgaaacattggaacaggaacccttatatggagattcgagccgcctcacgcgcgctacgtgaggttaagcgtgcttatgagtggtattaaccagttattatcctacc

SEQ ID NO: 517 - DNA, 1503 bp, Unknown; identical to SEQ ID NO: 384
  derived from dsRNAs of unknown virus

SEQ ID NO: 518 - DNA, 931 bp, Unknown
  derived from dsRNAs of unknown virus
gaatatttttgcatagactataggttatgtttacgtttcatcgacagagcgtaagcatgcctaaaagagaggctccagatatgcccactggatgcctatctattgacgagaagatagaagtaattgacgcatgtacaatactaataaggaatgagggagcgattgtcgcgcagattaacataaagcatggtgatgatggaaaaccatctatattcatgatgaacgtcaatgcgccatgggacaatccacacaaggatgtaagcataatatattctagaattatgagtgataaaccagcaccgcagccaacattaagtgataatttctcaccttgtaatgaaatgttaacaattgcatcagaaagcgagaagactgatagcaagcgtgcaaaaagtgtttcatttgaggatatgacgtttgaatcagcgaagaaagcattaccgcaaatcgatacgacgccatcttatacggattcagacacggaatccattcagagcaagacttttgatcaactcgagggagagttgcatgatgatggcccattatcaggaatgcaaatgacgacatgcggaaagaaatattatcttaagattaaaaacgatggtggtatgctaattgacatgaaggacgtttacaaatatagaccatcgcttggtggaccaaagaaggcaatgaggcgtaatatatatgtcatgaggaaaacacctaagaatgaagatgagtcatatacgataaccatgagtgtcaaaaagccaaaagatgcgatccatgttaaatcaattccacgaggagttgaagtatggatgagaggtccaactagattagaaacgcccatacaattacttgaaaactcaacacttgaagaagttagaaacatgttagtcaatttactttgtcagtagtcaaatacagtttatgcaggatgaacatc

SEQ ID NO: 519 - DNA, 1798 bp, Unknown
  derived from dsRNAs of unknown virus
gggaatttttaacctccattaaggttagcctttcagcgttactcaactatgagtatcgaaatcccccgtattaatttattaattcgataattaacttttagtaaaatatcttattttactttattttttaagttatataacttttttcaatttatttaattaaagtttttcagagtatagcttttaaaaacacattttttaaacacagtacacatatgtccataattcagattccacctatgaaccatattcgaggttcactttcgcgtgtaattacaagcgcatctaagctcacaaagagcactttagatcgtgtatatacaggatgtataacgcttactgttcgaccatctacagatatgatcgacttagttatttctaatctaatttcattcatccaagtttcaggcaaagcgtctgaggcaagaagaagattaggtccacaatgggaagacttagttaagaagtcagtagtaatcgattttatgcgggcttatcatttagcccaaatagtccaagacgactcttcgttctcatggacaacaatcaaagaggcctatggtagtatgaaagctacccgtatgtcaaacctgcttttccagattttatccgctaacactggcggatttgaaattcctggcacaggttatagattcttctataactttagactagaagtgggtattaacatgtacgagaaatgggcaaaatctatcttaggaaaagaatttgactctttgaagtcacaaaactatagaagcgccgaatattacggcgtcctagcatcggttaagtcattcattgtcgaagacttctttttagaaactcctaaacctacacttggttcaattgaaccaatgtgtcttggagatgttctattcaacgacagctcatatattgacttagtcaaatcatcaaactcaaagtactacattttgcattctgaaggtgtctcacctatcagtatggcattcaacattttcttcggtactaaacttcaagaagtaaccgtattaaatattaacttagttaatatgatatactactttattgaaggatcaccaaaggttgaagtacttgaattgatcactaacgtggcattcggtatctcttacaccgatggacagttactatcagacgacgcacagccgtttggtggtactggaaacggtggtaacgacggaccagacggaaaccctcctgatggccctattgacgacgacggcaaaggttctacaaacgaacctaacaacgaccctactaattcaccttcacaagatgaaggtggaagtagtggtggtgaaccagagtcagtaacgtttactgagaaccaacttgaccaacctaaactaccagaatcattgactaataaagcagcctctgctttagaaagttctataacagaagtattaggagaagttctaaccggggaagttactcaacttgtccaaaaccaacttctatccacacctgatattaagcagaagactcttataaatagagtcgtatctaagattccaggtcttgcaggtaatgtggttcaaaacataatacctattgcggtatccgcactttacttaagtgatagaaaccgcgcacttgaaggaagtactactggtacttctataagcttagggttaagaggtcctagcatctctagaactacaactaaaacaactgtcaagccagttaagcgtagtaaatagggtaactcctatttactagtactatacgtttaaaatataagtttattcgtattaatacatacagtatactactgtcatgggggctggcaccc

SEQ ID NO: 520 - DNA, 1700 bp, Unknown; identical to SEQ ID NO: 397
  derived from dsRNAs of unknown virus

SEQ ID NO: 521 - DNA, 2424 bp, Unknown
  derived from dsRNAs of unknown virus
gggcgaagaggaatccaatggacctcctcttccaggatgagaacctaaccatcctgcctttgtcccctcgttacataacgtaaagcgaaggtatctcttcagttcggtatttctaccttaccttagagaagacaggcacctgttagtgtactagcagcaagagcattgtcaacttagtaaaaagagtcaaagactcaattcataaagatgatacgtcataaaagcaaaaataataagggcctttggcgaacgtacccgtatatacgggacatttcctcaggattaaatattctcgctacactagctccacgtgagtgaagtagcgcgactactctatgcaaatcttataaatccctggttcggaaattaatcacgaaccacggacctgtcgaagccgcaaaacggctgaagaattatcaaaacttcgtcacccgacgggcactggagttaccagttgaaccactagagtggacccgggttgacaagacaggttggccaatcattttgaagccatttaagaactactgtacgtctcaagaccccatgaagaagcatttcgtaatctcagtatttcgatcgttagatctatttaaaggtcatactagtaaaaatatcgagaccatcgttgccccttttacagggtgtcagacggcactagatgaattcacaacttattgtaaaacatgagggaagaatttaaaagaacgacatgaacggtcaaaccgttcatgacgctttcgagaagaaaataatagcataaaggcgaaagccacgtcaggacccaatgggtcctccagcactttaagtctggttttagacgcggtaaagctatcagatagccatgaagtttgtgaaagcattctcatgctagctaaattgacatgttcttcagacctccagaaatggatgaagaagactatcgaggaagctggtcgcctatctaaattaagtagtaagtggaagccccataaggagctttctcttggtcgaattggttttgtacctgataaaggtctcaaaacccgcgttgtagctatcggagacggattttccgcagccgcgttacaaccagtccatgactacttaataactatgttaaaggtgatgcccacaagtgctgcttttaagcaggacaaagcgtgagcaaccctcatttatcgtactctccacggattattctgtggaagttctgatgctacagcttttacagaccggtttccaatcggtccgcaggctgcagttcttgagagtgtaactgatgcgaagttggctatacactgattaagtgtaatccagcgacaatttaaggttccaggtccatgtaatgatacgattaaatatcaagtcggtcagcccatgggctttctttcttcgtggccgttggccacgatcactcaccatgcactcgttgagtacgcagcggaccgggttcttacagaacgcgcttcgaaaagctttaaacgttcaggttattttattttaggcgacgacatcgtcatctttaatgaattagtgtacaacgaatacataattctatgtatcaagttgggacttgacctaaataaaaacaaaagcactgtctcaacacactgttgcgaatttgcaaaacagctgttttgacgaggtagtcgggtatcggcaattacgcctttatccctactcaaagtatcatatgatcctttgagtgtgttaagtcttttacaagaactttcacacctcggatatagctccatcccagcaattaatttgttgaatctatttccaaagaaatattgaaaacagttaataccatttctctctaatccggagactttcaattacaattgtaatttgatcgactggagtgaagccccaaaggggttatcacctagccagtacggttgggtctggactcaaaaacagttctcagaagcgctttcctacgcctccttgcttataattgagcgagaggttaaaaagttgcgttactctgataagagtaatcggaacttagtgaccaacaaattgtggtataatatccaagaactacaattgtctgatcctaagatcgaaccagcgtacacccgagcattctatgatactctgcaaaacttcggtaaagagttagctaaacttcggtttggtgaaactctgcactatgaatatgcgcagttcatcaagcatgcccggtcattggacccgaacatacatattgggaaagataaacgtactgctgtgaacgaactaaatgttctaatccaagcaataaatcaactgcgaaatccagacaaaagtctagatatttcaaagttcgataattttgaggtacaaatgtaccaaaatataatcgacgccattgcaggctctcggctatgggcttaaacccatagagtggagatttaagattccccgttaatcggggtagtctaaggatccaccacgtcc

SEQ ID NO: 522 - DNA, 1683 bp, Unknown
  derived from dsRNAs of unknown virus
gtaaaacttttaaacaatttaaaaatttatgctagtgaaaactaggtaattctaacaaaattatttatgaaatatgaaataattaaattaacgcaagattcgattgatatgtatctatctgatagtgcacaacaatctgcttccggatattttgaaaacttgtcgcgcggacagaaccctactcaacgtaccccgctgtacaaagatctctctagtaacgaggtgtttgatctttgggtaacgtttctgaaagcccgtatggaaagctttgaactagaacgtcctttaatcgagtacgacatgtctagattaggtaagtgtggtccacagggaggacttaaacctctagatgatcgtcttgatgatctattcgattattggcaactacccgataccgaaaacgttataatcgataaagattgtatcgagcaagttcggaaagagctatttggtagtgtgagagataaacgacctcttacagtcgaaaatgttattcagagagatgaatttgatgataaactcattacaaactcaggctctccagattttgcgaaacgtaacgatcctgccgttcagcgacacgcaattgatgacgcaaagtcaggcaaatggattgaataccctatgattttgggatctaggagtcaacgagggaaagagagatttatattccttgcaccatttagcacgaatattgttgaaaagcaatttctataccccttgatggaccatattcgtaatgcgaaaatcccgttctttgctgcatgggaaggtttcgccgaagttgaaactgattttgaaaatgtcaatttctttaacgatcaagtttcatacgtacaacaggactatacgtctatggataagtactttaactcaatgctcggagaactagtcttcgaagtatctaaagacttttaccaatcaaagttccacgacgagtggcggaaggtgatccagcatgtatttaatataccggtaatgacacagcttgacaagctagtcacaatgccacatggactgatgtctggatcgggtttaacaaatttcctcgaatcgatagtgtcgtactatctaacttgtaaataccgaaacactttacaggaaaatatagacactcagggtctaggtgacgaccttgttttcaactataatagtcgcaaacactccgaggaagatgtaaagacagtaatgttcgacgaatccgcacaactaaagttagtgttaagttcagataagcagagattcgatcagcacacgacagtatacctacaaagatattttgatgaaaggctgaatatcaatttaggtaattatcccagtatattagctttaaatactgcgatgcatcccgagaggtttcacgacgcctcgaaatggagtaaagagatggagatactccgatggattatgattctcgaaaattgtaagcaactgccttacttcgaagaactagttcaattctttatgaaaggtgacaagtacaaacttggacttgaaatacctaacttctttcaacagttaccaatcacgtatgaaacaagtaagtcgattaaaggctttgtaccttcttataatcaagaaggtcttgatcgtggaattgacagtttcgccactgtacaatatctcatgaaacaaagtgctacaagctattagcttcggcggaccagatctccatctggtctc

SEQ ID NO: 523 - DNA, 2751 bp, Unknown
  derived from dsRNAs of unknown virus
acgaaagagttttactcccctgactcttttgttaaatgcgtggggaacgcgattaattaatattaacatgtttacaataacagatttgaaggaaaatcaacaatttatatatcttggaatgatcgagcagttcccagagatcaaaggcatgaagtttcttacttacgagatttttatgcagtttgtttctcgttcggggctgttacaaaaatacgcggccaaactaaaagccgaattttctttgcaatctcgtactccggaattcatggagggggttattacagcaaaagatgagcttgatgcatttcatgcttctatcactgctatcaatgccgctgaaaagtctaaatcggaatccgcacgattagcgtctgagcaataccaatcaaaaatacaagtaattaataatgaatttgaaaaatcagtggcagctcatttagtgtcggatttggtaaaaatatcatcattaaaaatagaaaatctacctttatctactgttatttcagctgaaaaggcctctgctttattagttaatccaaccgatgcagataaagctgatgtgtggaaatcacatcttcttgcgcataaaaaagaattagttataaaatttaaatcgggtaatttatctgaggcggattttcaggcgtaggcgttgttaatccgactgacgacacatttgacaaatatgaatcgtttgtacataagttagattctttagaaccatggtttgattctgctattcctagttttaatccgaaattttcgaaagtttcagttgatcgttattctaataatgatattaaaggctgtttcttaggagttaagggtgctattaataattgtttgaggcgtggttctgctaagagcgttgtattgcctaatattgaatttacttctgctgaacgaacaagaaagtcagaaaagatttttgatgttaggaagtgcaatcctatagattatagaatcaaaaacggacgtgtacctagacggttcaaaaagtacttacctgttacattagggaaaggttgtaagttagttggctctattggtttaagatttcaaactgagtctaatttggtggaaggtgtgtctaaacctaaaatgttcttttttgataagctgggtactaaaaaagatttttctttgacagctcgtcataaagcgtattctatgggtaatattgcttttagtggtggttttaacacaaattgggtaaatcttaaaagtatgtctgaaaatgggcgtcgttcttgttattcgaatgctgaaatttttaaagcagttcgtgctcgttggaaaattgatttagttttaccttatattgcttctattcctaaggattcatgattgaaatgagtaaatgttcgaaagaacacttatccgggtgttttgtctaaattattgtttggtggtacgagagctcgtgcggctagatttactattcctcttagtaagcgtatttgggatctattaaaagtgaaaagttattgttgtactgcactgtatggttatggagctagggaaaagatgcagaaaatcatcaatcctattggttgaaatcctacaaaaactcgtcttgtcttaatggttgaagaccatgtaaatcgtgttttaggtgctattttacaacctctgactgctgctaatagtttattagatcgtggtgctataatgattgggagatcttgtcgtggtggtcggtatcatacttgatataagcaattgactaatactaataataagagtaagcagtatctcaatttcacatctgattttagtggatttgataatactgttcgagatcgattaattaaacatgctatttctattttacggtgttgttttcctaaatctgttttcgtagataatttattcatttatttttattcttctctatgttataaaaatgtggtattaccaagtgggtatatcgttaggattaaaggcggaatagcaactggtcatcctggtactagttgagttgggtctattgtttcttggattgctttcagttgtgcaatttattatgcttttgaagatgatgagttagtagatgatactttcttgcatattcagggtgatgatgtacgaggtcgtttgcctaatactgataaaattaaaagaatcgatagatttttagctaaaactgggttagttgctgatcctattattaataacattggtttattaattagtagggatgaaacttattctattcctttcttgaaacaagtttttaagttttcaggaggtgtaggttgggttcatctacagatgctgattaatttattctctgttgttaagaaaccgcctcctaggtattttgatagagctcagtctgttttgggttatttatatgcttctccgtttgattatgagcttgttgagtttatttcatttatctttaaagagtatataaagttgtcggttaatcaggatttattttcgggtaaattccaattgactaatgttgccaaacaaactaggcccgataagtcattagcaatatcacatcgtattgctttacgtcagatggaggttcgtgaacatccattgtttggtaaggcatataacgatcatgattggcaagtggtgcgtccttctgaagctataataattaaaaataatacttttttaacatctggtgatatgttcgatgttctggactatatcataacgaagtagttttacggcaagttttccgtttaattacatccatactaatactgtcggatattggtatggggttcg

SEQ ID NO: 524 - DNA, 1879 bp, Unknown
  derived from dsRNAs of unknown virus
tggaaaatttcataataggtttatattatttatcataataagtttgtaaaaaataaaattattttaattaaattctatttatttacctcgttaatagagaactattattggtatttctataccaagtactcataaatttatttattgagttactaaccaattaaggtggtatacccttaacatgattgcactcaaatacaactgtatggacttaaatgatcagataaaaaatcttaatcgtaaaattcaaatggatcccgaaaacccaaaagctgaaagctggaaacagcaagttaaagggttaaaaaggaaaaatgaggttcagtcatcaggtactggttttggtaaacaaaaaccaaagttacctgaaaatcgacctgcacaacctccaaagcaggccagtcaaaatcctaaaaatggaaacgcggaactagatcagtcttcaacacctgttaaaagcgtgtcactattttcttttggacttgacaaagtaatagctggttttcaactagctattagacaaattaatcttgtggctggtaggcccgtcttcacggggtaccatacacaaagagtcacgcactatgtttatccgagttacgcatgggtaactcggattatcaagattttgcaattaacctttgtcggaacggaagccggccgagaatttgcaagggcgcttggaatatcgggttcgatagccaagcgtggcgacttaaacatgtatattgaaatagctgtaaagtaccagctgttaacaatataccaaatgttattcgatgttcagaacggaactaaaggtgcgttcagtctcgaagacatttatagggcatctggataccttaaggtattaccaggtacccgagcttttattgagatggtagcaacaggcgttgtaactaaacaggtagccaatggttatacagttcaattacaagtcgtgctaatcgacctcgagaaaactccctggaaagacgataagtactaccaggacttgaaaaagtctacagaaatgaatagggccgaatacagaggtatccacggcgcgttttacgcgtctactagggatatgtttgcatggaggtcttcagaagtttcgagtagttttaacccaccaccaatcgcagttggtgactgtactactttaggactagttagtgaagaaactgatttttcaagtaactctgagactatattcacagagagagaagatggtactgatcagaatcatattctgattaataacatgtcaataaactccttcacgcttggattgaatcagtatttcaatactcatacaagtgtagtcggagatattccggtcgagtacgtatatcaaccaaggattggatccttcggtgaggcatacactgcggttatttacgaagtctttaccggactcgaatcgacgctccctattgataataccaattggattggtccgccaggtaatcagggtggtccaggtaacccacctgaacctcgtgaccaaggtccaactggaaatggtgaatcacccgatccacctgatcagtacgtcgaaagggaactgttagaacaatttgacactcaggaatcatcaacagacttgagtaacgaattgtcagctatgctttataatgaagctagactagcaggaactggtgctgtccgaagtgcactgcgcgaagcagttcaacagggtggtagaattattctaaccattgctggaggtgcacttggtgcgcggatagggtcaagacgtgggataacaaatatcaaccaaaggtcgtttaatttgcatcccacaattcaatttggtccaaggtcaattagattgcccttctaaaccaatttgttaaaatcgcacctgggattcctatatattaggaatcccccc

SEQ ID NO: 525 - DNA, 4747 bp, Unknown
  derived from dsRNAs of unknown virus
tgataaaaacagaaaacaatgtcggttgtaacaacagatgtaatggatactgatagtgggtcagaaattgacctgcagggcttgcccaatctgcaaaatgcagagagtaataatacaacaggcaataaaatgccaacaacagatgatagtctgaagcgcatccatgagcgccacaagaatagtgccgcttcaaggggccgtatcgaaactgtatctaccatggcaggcattgatgttagtggtggggagttccaccagaatttgcaaaaaccttacagatgcgattctgtcgaagttggcgcactttttagcaccggggccaagatgccaaacttgaccactgataataatatgaagaaaggtgctgctcaggctggctttcaacctggtgcggtgcctcctacactatcttgtgactctggggatgctggttctggttgttacagtatggttatggagcccagcctggagctgttcatggaaatgaggggtatggcaccgaataaaataaagtgtggcaatactgagaatgctcttgtcgctgcacccaacggtcaccctttgctgaattctgtttgtcttgatattagtgctgaacagattactacagaggacggcaggctgatggggtatgtgacaggcagcgcagtcgatcgggctaagctcgacctggccggtgacatcgccggattagtcggctccatgcctcaacgcatctacggcatagctgcacaaggcgctaataaagcggaagctaatcctgacgaccctttcgatggtcagatcaatagggctggacgtgctgtagatactaagaatgtcaacaacatgatcagtcagtggctctttccaattataccaggcgaaaaccacatgcccctgtttataaacatggctatgcatatgcgtgaggctgcacaactaagtatggttgcacacatgcataatggcgagggctgcaaattgggcgcgcactacacgcgttttcgtacacctgttacttcaactaagaaggtcatttaccctgctgagttggtcagcggggctggtatggattatattccggtgtgcggctatgatcttgctgacggccatcttaatctgcttgcgattatgcttcagccctgccagacggtgggcaggtattgcgagactgagatcagctcgctcaagcccgctagtgcacgttttgtaatccgttacagtggtgctcaggccggttacggcggtggcagattcaaacctaattataagatcgtggttgcaggaaatcagtggaattcaactgaccgagaggttatgaccaacagcctagtttgcgatcctagggctttatataccgcggcagctgcatatgcagacagcatctgcgcgaggcctttgctcgaggatgctatagagatgatcaacagggtctgccctcattatgaggggcgtaacttgccagctaatcacgctatcaatatcagaggcggagtacctaggcatgcatcggattggctacccaccaccctaaagaagatggaggaagcttacccagcatatacgcaccccagctatacagagcacctgttcgagctggttacggggggtatggtcttaacatatatagacaggactatgattgctaacctcgctgtgggtatgggcttaactgctaaggcgcgcaaagagcggggcattagcagttggcgtggagtgcggcatgaccatctcacttccctgcttaatggcacttctacgcagaggcgtgacaagtacattaatatgctgaacaactactgccctggcatgctcggtcgggccgccctattctgggaacccatcagcaatgtgctggaggataagaactttggttcggttatggctaaatatggtcatatgtggggaccgttggcactaggctgcaaggcaatgggtcaaacgttccaggctgtaatgtcagacagcggcgtcataccgagtctttctgagatagccagcgactatgactccatagatactaataagctggtgacactacacgccttcggtctgttgaatagttcaaatgtggcaggggctcattatgccacagtcaatagttacatcgatgatgttgatgcgatcaggtacacgatcgaagactttagcgcagacagatttgccatgatcacggacaggacatattttatcaaaataaataataccaaacattttggtcaatcggcgcgtactaagtctatgacgcgcggttctctgatgagaggtttcttcgatgacgacgaaagcgacgacgaaggggatgattactcgtcaccgggcgtgttagcacctagtctctcgctatcagagagggcgccatacagcagctccagcttacagtcagatacaaccataaagtctggtgttatcaagcgaggttcgcgcggttcgtccagccgatcagaccccagcgcttcaagcagccttgagatagttaacccaacagaccagctgttcagggaaatggatgatgacgagcagcagcgtgcatttgaccataatagtgaggcacgctcacctgacccggactcgtacgttgctagcgtgaagatggggtacaccggaccagctaggaagcctgacgcacctagcccgcagcgcggtaatggcgggggcgttaaaggccgcatacctgtccagagcccggctgacaagctgaggtttgacaaaatgtcgacgcctagggagatggaagatgctgccgaggcttttactatgctagccattcccgactctaacactgacggcatgactaacgcatttcacccacgcacaccaatgagcatccaggggtatgggttcaggactatgcgcactattgtcatgatgtataacctgctggccgatgaatcggctgacgagaagacacaaactgagaagcttgaaacgatgcttgcagacctgacttgtgacgctaacggggttacttatgtggcccttgccatagtcccaggcttcaatgcaattataaacggcatcatgaggagggctggacgattttcccggagggtcgaaggcgtcgcaagattactcttcagggtatgcaatctggcgccagaggggtgctggggcgtggtggtgcgttcagaaaccgcatcaggtttcaacttgggagcagcagagaccaaatatgcccttacgacgatgatgggtgcaggctggtctttgacaatgaagccagacatccgctttgaagttaatgaacactatgacattgggatgtacgccactatctcgcagaaggtggagccatttgttaggcctgaaccgaacgccgacaagaacagctcgggcagagtcgtaccgggcgaggtgactgagcagggctgggtggggcagtcgaacatgaagatggtcaaggagcttgttgctattggcaaggcatacaactatacaacatcatcaacactggcaggcgcactagaggcggcgcggggactgaacagggacattaagcgtgattgccttttcaggttcttcaattcgaagaatgaacaggtaccagtcattgtagtaccactggggcaggagctggagacattggcaactctgggcggtaagataggcgatgtatgtaaccaagcaatcgcgcttatcaagggacgttactctaaagaaaataaggagtctgatgatattgaggaagtgacgacgtcccagttgtttactgagctagcgcaagcggtggtgtcaaactactacggttcccacagggacgaaggtatcattttagtgccagggtacggcacattgaagaacctggtcggagatgatcatttcttcactaactacaccaacggagacaagcttttgagcgctgtgggcgaatgggagcacgaaattggcacgaagcattatattgcttcacgggatgacaatgctaagatggaagagtactacaggctagcgcttgagggtgataaggcaaatcttacagatacaaatgcaggcagcaaagtatttgacgagatgctgatggtgttgtctgaaagggcaaagacagacccaacacctaaaatgagtgcgaagcttgccgagcttaggaaggtgaaaacaggcgcaaagaagaagggcaaggcagtggtgagcaagggcacgaaacaacttatggccgcccataatgtcaaggagtaatggtaaagaaaggtaagaggagatattatattaaggcgacagatactgctgatgaagacagcgtaatggagagccgtattaagataaagttattatgcaatgaaaggtctcaagctgtagatggcgaaacgtacagcaacggcgtggagcggtacaatggcatattctatgcggctgatagatattgggtggcagtgcctgtacttttagctaactgggtagtaggtagagtaccggcttcacagtgtgagttatatgaagcgcttgatattaggaaggtttacgaggaaacaatgaatacgctgttacacagatattcaataaagtcgcatttggctatagagaaatatataactgagaaacataacactgaagtaccccagatagtgataggtcacacttgcaatgtggggtcgcttggagtagcacataaaccaatgtgtttcagatcagccatgcaagagatgataagaagtggcaaagaagcgcgagtaactgtaatggtatgcaggcgcaatacaacaacaactgataagaaataatcagaatcgagagaacttatatacgggagagataaaaagaacattcg

SEQ ID NO: 526 - DNA, 1410 bp, Unknown
  derived from dsRNAs of unknown virus
ctctcgccacttttatcgagtagctgcgcactctccaggtgcgccttgccataccgaggtttggtaggtgcttcggggatgagcgtaagtatggccaatgtcctccgtgacatcagcctcagctcactatttgacgataacaggccggtattcccatccgtctataggtgggaatacttcttcgacagaatggctcctaaatctaaggagaaagccggcagtaacaagtttgctggcagccagtcgaagaagaagaagacggcaactgctccacctgcccccaaggggggaggtggctccgataagcggttcgagttttcgaccgcatcgggacttcttcgctctcttcctgaactcttcaacctgattgcttcggatgtaagctaatcattggttcattaggaagttcgcgcattaagattttaacgatctatatccttgacctcgtcaaggtgacaagcaagctattggcgcaaaatttgcgctatatgcgtgctgcgcacaagggatacagcaaggttcgcgccgactttgaacagtgcgacgttgtgccgacggcttcacagaagctgttcgccgacatcgaggaggcgtacaatgcttgtacgactgcctttgcgagcctttaccctgacaatgcagaagacttcaagtctgacgcgcccgacaaagtcacgacgggcaaacgtctcgatgaaatcgaggcgaaactcacggccgttcaggagaccgggtcaactgaccatgcgatcctgaaaaaggtccacaagatgcttatcaaggtatgtggattttgagtcaatgtgacttcgttcaattattaactgtcataaccatcataggtccgtctgtcgacacgcccttcgctagatgcgaatggacgtccgctcgactacggggatgagtccggattcgatgacctcgaatcttcggacgaagaatcccaatcggatgacgatggttctggagccgcagctgcggccgccggcgttccgcccaagcgtggtggatcgggaaacccccgttccacccgccctgggaagaagccgaagaaatgaatttgacaggaatcgacaaacgttggagtttgcgactgaacgagagaatgcggaaacggtgaatgaaaacagccgtatatatcacgcatctcagggagccctcaatgagaggatgtgcccccggaattcctttgccatgaaaactggcaagaatcccccctaggacaaaggtaatttgcccccccccgggagagcgtctgcggttgagaaccgccatagctcttttgggtatcaatgaagtacttctctgactccgaaaataggacatcgagtttccgaacataggaggtttaccatcaggaatgggtttttggggaacatgtccctatccatccatgaacgatgataatca

SEQ ID NO: 527 - DNA, 1449 bp, Unknown
  derived from dsRNAs of unknown virus
gaataatattaagcaactttgaaagattaaaaataagggatacaagatgaacgaagaaatggaaaatgattttgaagacttcgtcgcagatttggcagagcagatggacgtaaataccgcggatagggatgctcatgcaaacagagaccatgtagttgagaattcgaaacttgagttaaatgacctgggatatgggcgttacaaccaaggtgtaaaggatattcaagcgtgtgtggctgacccttcaaggaatccgctaaccaaaaacggtaagctagtactttcgctactagggcgctcgaacgatactaccactgatgacattgacgaagagtataagctgaaagcaagtcttacaactgctacagagaagctagattcgttaagagtaagacttaatgagaaattgttaatgatgtcagatttcggtaaggatatagttgaacgtcgtgacgcgtataatgtcgcaataaagagtgaagaacccgacagaaggattcaactacgaatggcaatggaaagcctagcatccgctgaggatcaatttaacatgattggtgatgaacttgttcgcatcgagcgtgacgttgatagacaacaagttattgtagatggactggacagcgatttgacgaaatttagaaaacgattgctacttacgcagtttacagctagatccgtgctttttagtgacccctccggtataatgagtaaaggaaatatggatgatatcccatctgaacagaaggacttaacttcaatgcaacttattcgacaagcaacacttaaggatgtcatatctacattgagtacgctagaaggtgtacatgtggaaaatgatgatgattcgttcgcaatgttcgctgacacaggcgttggagtggatgatacaattaaatcatggagcggaatgttaaacgacaacatgataacggattacgagtatttcttgaacaactcaagtgttagcaagtcaatccaagcaattttcgatacagcgtatgatatggagagcattagaaaagggaatgtaaactacgagttacgtaaaacatcctcaaaatcaacaaataatacattacaacgagaattgtatttcttaaacttaatcgctcaatcaggttacaatcccacacgttgggcacaggcattcggagtaccaattagtggaattggaaaacgcatcctggacgagtggaaagatagtggttatgtgcccattacggctgatgctttgacgcaattatttgtgtatgaggatttcaatcagtccattggtattgattactctagattggaagaaacagtgattgaaaagttcaaaccaaaggataaaaacaaagtagacgcggatacgcttcgaaatgtatttaaggaccttgaacgtgacaataacggtgattccgacctacgagataattaaatttcatattgcttaaatgaaacatc

SEQ ID NO: 528 - DNA, 1933 bp, Unknown; identical to SEQ ID NO: 315
  derived from dsRNAs of unknown virus

SEQ ID NO: 529 - DNA, 1742 bp, Unknown
  derived from dsRNAs of unknown virus
gtaaataaaacctttatatatttatatataacaatcttatttcaaattatttaattatattatttttaattatggaaatattaagtctttcgccagaatcactggataagcagctaactccgttagctcagacacaggctgccgctggattccaaatgttgcgtgaaggtaaagcacctactgcgcgtactcctctttacaaggatagcagtgaagaagaagtattcgctagttggctcgatatcttgacccgatatgaagaggatgatgtattaaagcctctgatcacttatgataaatcgagaatgcccaaggttggacctcaaggtggttatccgccattctcggagcgaactagtgatttcgaagaatattacacacttccagatcaagaagaatttgcaatcgactatgatctatgtgctgaaatatacttagaggtgtttggaggggctaaggacaaaagaccactgtctccacaaaacgtcgtagatcgcgatcagtacgacgacaagctccagaccaactcaggaccacctgattatggcaaacgcaaggatcctgaaattcttgctaaagcagtagccgacgcaatcagcggcaaatggaaagagttttgtatgattctaggtagtcgttcacaacgaggtaagtttcgcttcatctttatggcaccattcagtctgaatatagttgagaaaacgtttttgtaccccctaatggatattattcgtgagattaataatccattcttctcagcatgggaaggttttagtgaagtcgaactaggtttcgctcgccagaaattcttcgagggagcgtttttcattcagcaagactataaatctatggataagtctctcaaccaaacaacaattaagatctttcttgccatagtgcttccagtttttcaaaaacaacatcaagaaagtcttactgagttagtttatcatatcttcaacatcccaattatggtcagccttggcaaattggttgttggaatgcacggaatgcccagcggatctggattcactaatttcttcgagtccattatttcctactacgtgtggaaattaaatgataaagacggaggactcactatccctcgcgcccaaggattaggagacgatttggcattctcagtacaagcacccggggattggaaggaatataatgaaagcgatatgttcgacctctggcttgaaacagccatggagtatgcacccgatgtaatatccgagaaaagtgcctcaataggtttaatagtccaacctgaaaaacaactgatcgacagatacacgacaatttacttacagcgattctttgatgtacggattccaaacccgaagaatgatctcgtcttaggtatgtaccccagtatattggcattgaatactgcgatgaacccggagaggtttcacgaccctcgaaaatggagtagcaagatggagatactccgatggattatgatcttagagaactgcaaaaacctgccgtactttgaagacctagttcaattctttatagaaggggacaagttcaaattaggacttgctgacccagaattctttataatgttaccgtcaatttatgaagattcaaaactaattaaaggtttcttacctacttataatcaagaaggcattgatagaggtatcaatgactttgagacagttaagtatttaaagagattggccagccaagcctaaacgtttgcaccaagatctccatcttggtgtttt

SEQ ID NO: 530 - DNA, 5132 bp, Unknown
  derived from dsRNAs of unknown virus
gaatgtattcgtgcatgaaaattactaggtgaactagctaactggggtgatataccattgtaacaccttggaaaactggagaatcagagtaattgtcacttcttgtcttatacatgggggatgtttttacatctcttgttctcgtaccgaacagtcttaggggtaaaaggtcagctaccaaactgcgcagcgcaagatatatgctatacgtgatatatctgatggtgtgagcagtgcccaccgctagtggtaaaaacgtggagtcattaatttgcagagcatgtataccatggagggttggcgtcgaaagatgccacttcccaacaatagaatggagtttgcaactcaggttcaaccgtgtactgggtgtaagttcgaattgccagctgaggccgtttctacggtctcggcatcggtgatatcgaaaggtataacctatacaacggataaggacgttttctatcaagtggaaaaatatgataaaggtggaaggcttgtgtgtaaagacacaggtgtgacacttaggaaggagataagtattggtgctagtgcactcaggtcggcagtgaggtcgcagattgagtgcctgtctaatactagttatgagtatgacatgcgtgcgatatgttacgcattaggacatatggtgagctgtgtgtggtcaggtaaaactgtcccaacagctcaaagtgaagtgcgttttttagccagttacgctactgcggtgtctgaaacagacatagtattctgtatgccacagaacgtaggtagggaggtgagctgtatgcttagcattgctgctaagtactgtggtgtagatcgtatatatgtggctgcaatgcaagggttgaccgcgagtgtgcccactgacaacaaacagtggcgagtggctttgcacagcacaattcaatttgtattgtcagatgcagcatcgctaggatgttatggtgaacacgcggttgcattttcacgtggattgacatcccatgtaacagtacgagcacatagtgatgaaggtggctggtggcgcagagcgatcaggaacgctagctaccctaggccacgtgggtatctcaacactatattgggttcgtaccacatgccacatttcggtactcgtagaactaacgaagctacgtttgccaaggacagtatgtcaatgttgttgactttcatggcatgtatccaggatgcagatcctctagctaacattactcagtcaacattgctggttaatgaagttgtggccactcgtgatccaagcgaagatctaacaaaagtgctgacaagtgacgctgcaaggaagccgacagcttaccctatgttgcgtgtggtcatggacacagtggaggaacacgctgtaaggatttttaacctaacacatgcggacgtggatagagatcatcatatcttgtcactcccacgtgatacgttcagggattatctatccaacaacacaacggattcgcacctgggtgtggagaatctactaccttacttattcatcgagaatggtgctgtgttaagacatgacgcaagtgttaagcaggcagggccgcgcgctggcaggaagacggtgctgccatattttcctttttcaacagtcgcgacaggtggagatgacagagggagtaatgcaagaggagtacagaacgcagaaatactatttgctaggataggagggaaggcaatacgtgaaataggaatgtattatgttgctagcagcctttggacaggagagaacagcggcatgcaaggcatagatgtaatggtcggcaaggctggacctggagatgtgtcaatggctcgtcaacatgccgttcaaacgttagataacataggatggatacgcccacattgtccagtgcctgcgccaggcgagtgtacctttgacgatcagggtgtgttagcacgtatacatcgtgataaagttggtaaggtattcttggaagctggacccccgacgtcattagaagtgacattatctgtatcggggttacgactcaatacagcaatcagtaacctcacatccatgacacatattgtgtcaaaaaatatgagtgatgattacaggcttaaaatgacagatgatgaggtaagcatggaacaggaggcagtatacgaagcaacggctaagttattccatttgaatgttgatccacgtattaacttagccagcaatacattcaacactagtagtctacaaaacatgagtgtagaacagatagcgagtgacccaaacgaccagggggtcaggcacactgccgcagataacgaagcacaaaccagtagagctgggggtgctgtgtctaaagtgcctatagcaactaatcaaacagttagcactggagcccaagctgccgccgtaaacattatcggtgccagcggagcgccatgagtcgactagatattacgcagcgcatactcgtaggttgtgtgttgcaggggcgagatggtatggagttagtgcagatgtctaaatcattatatgatttaccaatgcaaataaaaatgaatgaaaggcaggtgatacaatattactggaaaaaatgctgccctagatggagagagtttaaagaaacagtgaggaggtgcggttttgatatgtttgaagcatatgcaggagtaaaaacgcgtacaattaagtcaccggtgtgcaatagcacgacgtggtggaaaacaagctataaaacaggcatgacgagtgattggtggtggcagtcattaacaggtgaatgtgtagctagtgaggaaggagtgaaaatggtaagatttacattgggagagagcttgtgtagcgctaagttgtctaagcagattaaaatgttaatagctggatcagtagatgatagagatgtttttccactcaaaggacatataggagcggtaactaaagttaatgtatttatgtcagatgctgtgaaagatgcgagattagtattaggtgatgatgtatgtcaaatactacttgagatgatatacatgcgacgtgcttgtacaggcaggtgtacatataatgatgaggcgtgctcatggttactgtggtgtgtggcagcactggagggtggtttgaatccagtacctgcattattagtcagctatgacgacctgaaagaaatgagtaatgacctgaaagggtgtggtgtggtgtgcaacccctttgctcatatgttagtcgaaatggctgcactggagggtagaggcattggtatgattaacatagagaatgaacttaggaaacgaacagacccggagagttttgaaggcatgttagcaaagttcaatgcagaagacctgacacgcgttgttaggcaaatagtacgtgaagagaggggagtaatagtatgtcctgattggaaaagatcatgggcgaacagatttgctacgactaaagcaggttcccataatgtgtgggcggggcaggaatgtagtttgcctaaacaacaactaacgaggcgtaattacgtagaagcagtggattacatgggagttgatgaaatagaacctcggggttacgttagtatgtcacagaaactagagcagggaaaaggcagagcgatatacgcactagacagtgataactaccttagatttgaccctcctgccagagcagtggaacaggcgtggcgtaacaagcgagtggtactagcgccgtcaggtgaggaccaagtacaagatacggagaggcgtgggaagcaactacgcaagtggaaattgatgtttgattacaaagatttcaattccgcacacacaactgaagcgcagaaaattgtagtaagagagattttcgactttctaccagaaaagtggttacgatggctggtagatagttttgacaaccataaaataaaacatcccacatccagcgagttactacatgtcaagggtacgctcatgtcaggacataggctgacaacaataatcaacacggtcctaaacggtgcatatgtacgactggtgctgggtgaggacttatactcaagattacactgggaacatgttggagatgatgtagtagcatcaacagacgatgctgatacagcagatacaactataggtaagttgatggctagtgatctgcagctgcagagaaacaaacaaggttttggcagatggtgtgcagagttccttaggatcagctatgacgggcatataggtactggctacttagcaagggcgatagcatcgggcacatgtggcagctgggttacagatctaaaattagactcttcaaaatatattgtcagtgtgttacagatcatgtggacacttagacagagatcgcaagggtacacgtgttcattgctttttacaagcacgattgcacgtagattggggctatcttatgaggatgcatggggtctagcaacggggcgggtgagtcttaatggctcacctgtatttggcagcaatagtggaaatgttgtacatattaaatatggacagacttgtggacacttacaggtgtcaagaaaggtgcgcggaatacgtttgccgcgcaaggctgctaccgattacgcagctaatagtacagagtatagtgcactagtgaagtctggtgtccatagggctgtgcttgatagggcgatgctagaagcatcatatagtaacctattcgagcgcaaccctgaccggggacagcagactgagtactctgaaatatctattgataacaggtggataagaccactaggttatgatacaaaaatagcaaaaaataacaactttggcgcactagccaacttattaggtagtgcggtaagtgatgaacagtggctacggtttggtgacataattgagagggatgtatctacactaactagctacggtaacacagaggaagtggttgttagttccgtctttggaacaccatattcgtcactacgttatatagctaaagtgataaggcaaaactgtatatacaccactgtatataagctgatgctatgataggtattcgttattagtaacgagaaatcaacaagaattgatatcattatatgaaatgattagtattctagaagaacaatacatatagtaatatatgtaaccggtaaaacagcgggacccataggcccgttataataaaatacttaagggtaggatgtaaatgtactaacgtcttttattgc

SEQ ID NO: 531 - DNA, 2845 bp, Unknown
  derived from dsRNAs of unknown virus
gtttaaaattgatgttgattagtgttggatgtagacaattatatcaaatttaattgacgggtttatatgaagtttgtattgttatatgtactgaaatttgcattttatgtcacaagaggtttgtgaaaccgggagaatacatgtacgacggtgaggagacaactgtgaaaaaggggaaagatggtacgggtgcgaagtcaaaggcagggaatgacacgggcgcaaagtcaaggaccgaaggcggtgcaggcgtgagaactaaaattaacacagcaatggtgaagggcgtcccaatggccatcgagcctgttccgcgggtaggcgtcgtcaccccggatgttcggggagcggcagcattattagatgaagcggaaaagaagttaggtgatgataatgcatcaaagttggaattttctgaaggtacacctgtgtcagacgttacaaactcggtgctgaataaggtcataaatttgatccgggagcgcggcactgaggtggttgaaatgaatcttgacgatggcgttatggcgcgacgatcttggccaccaggtaacctgcgtgtgatagcatcagtagataagcagcacttgctcctgcacgagacgctacctcaactatctgttagtccgggagatgacccgatgattgcgatggcaagaatggtgaacgaagtgatcatggcgatgaatttaggtagacctttcgtgtattctaaccccaacaaagaggtgtatgaatgggttgaatatgctaatatcggatcggatctacgtgcgctacgggcggattgcaggaatgtgcgtggcattggccaatctttggatgatcgcgttgtgaacctattacgatctcgagccatttgtcgtactggtggtgactttgatgtggctaaggtgtttgacggccgtattagagcgcaacttctaaccgacgtggcacacatatattggcaagctacaatcagtctaccacagttgtatgcaaagtatgcgcccatgtcaccagcgttccgtacgccatacttaaatgaaatagatcaacgtgcgcgtgtgttcgaaaatcatgttgcggatcgtcgcggaataccgcatcatttcagtgaggacaccgcagagatagccgtcgcgatgatgagcgaatgtatttacaagttaggcatgacgtcgacaaatccaatggaagtggaatctgacatagcacgtaccacactcgcgcagcacgagcagagttctccgctagcaataataacaggcatgttatcaagcacggaagttggccctaccttagccgcggtagtactaacgtgcgtgttccaccgtattagagtgagcgtagctcttgacgtcttagacccatcgttagcgaatttcctcgcagccgtttccgttatgctgatattcccgcacgaggtactagaggaacagacgcaccgtgcagcgaaacagataattgcgcgtggtttggggcgaacggcggctgtcaccgcagacataagcgagttaactggcatgttgcaacagttcagcctatttcaaggtttctcaagagcgcgacgtgctgtcgcagcatccgattcccccttcacgactaacaccacttacagtatcccgctgttgacggacgcgaatggtagacacgtacttgagagcgcattaccgggtacgatcacgatgctaagaaacaaacaaatgactcctctactgctgtcgagttttagtaacaagggaggtaatcttatcatagcgattgtcaatcgtatgatggacaccgtacacactcgagctgcttctttaagtcaagtcattgcaggattcgcaataggagtgggcgttgagtggcgtgatcttgagttggttcagccactttacttatccaaaaaaagcattttatcgtttggtcaactatatgtggaatccggagtgcaagagacgtttccattcgccatgcgtgtcgcttcacttttgcttggtattacgaatgcagtcatcgagatggcgccattcgcagaaggattactgttgataaagaaccgcggtcgccttgggatatctgagagcgtacgactagcagaggagattgatggagagatagacagtcagagtttcgggattatagccatgtccatgatcaatagagcaagggccagaaagggacgagcgggtgtgttgcgcttgctccagcagatagcaggattcgttgacccaaacgctacgatccgtcttatcaaacagttagtgcgcactaacatagcagcaaatctgggggcgttcggtttgacttcatacgtcatcctttcagcccgtgcgataccgcctgatgtccaccatctcaatgacttatttgaagagagcccattcagatcacccacgtgtgtgcagcatgatctagcgcatgccgatcttagagttatctcccacgaccgtttagcaccattgattgaggacggtgtacgtattaactgcatgatgtcctatgacttgatcattgacggtgtagataacagtaacactaccatggaaactcaaccactgtgcgttagagaaggtggagggtacgacctacggaagttcgcagttaccgctcgtctgccatcatgtgacgctgctgtttctggtgccatacgtatgagccatttgatgtctcctaaattgcacgtatacgtctccccccgtacgaattttcaccctgtctccgatatggaacaaatgacgcaggatatttctttcctatcaggtgatatacaactaaaaccccacaagatcaccatgatttcgtctaacaccatcccgcactaatgagccgccaatgacgctttgagctgagctgaggcatattgattccgacc

SEQ ID NO: 532 - DNA, 3915 bp, Unknown
  derived from dsRNAs of unknown virus
gtttaaaaagtaaggagaacgtttagaacaggctatgaacttgattgatgctttaaatattgcgttagttatattgatgttaattattattatcttgttgattttctttaatttctttgatatctgatttcttcgattctctagtttctatttctatcttatttctatctcatttatgaagcgtttgttgcattatggctaggagggtgaccacacatcaggatgacatcgctgtgatacaagcatggacggaggaattcttcgccgatgctgaacggtacgaagcatgtgtgggcgtaccacaaccaggggaacgtcgcgacgtagtgatcgacggagtgcgggtgggatacgtgacacgacgggatgaaccaaccctacggtcccgaggtttctcaggattacgaaaggagttacataagatatttacgactgaaggtaggacgattccagatgctaaggaacatactgttccttgggatgtgactgaattgggtgcttcctttattacaagtgagaatggtggcatggttacggagggtgagttgcttcatttggaacaaccacgtttgcgagcatggtcattggacgcactgactgaagatggagaactggctggaaaagcgcatgttgacattcgaacctggatgataagacgattggcggcggaatgtccgcaatcaggatatgcgaaagctgtggatgtcgcatgccaacttgtcagtgcacagccgtggtggcgtgaatattatgcttacttacgtggaggaggcatggagtatagctatacaatctcacattacgggaaccgctatgacttcgacgataaagagtacgtaacagacgggccatctaatctcatggcaccagtgcgcctgatgatgactattcagagtgaaatgtactaccgtcttttcttgaaacactctaatgtggctgttaggatgttggtcgaaatgcatgaatacttaatgatggatccagtcttccgtgttggacaggtgcgacgtcatgtaagcatgttgcatgcagcatgtttctctgggagcaaaaccggagatagatgtatcgcgtcaggatacgattcgttgaatgccacgaagaaagataggatcccacgattcgaccgagctacggtggcgtcggccagatatcattacagctacattgatgaggaagcgtacacggaagcggaagtcgccttacagcagtgtggacttattgaaatgaggagattcctgttacgtatgcggcgcgctgaagtgcgttggcgtaacattcgggacgtcggcgcagtgcagactattatgggaatttctggatatattggatctcatgtgacatcagcggtagcggaccaactgctttcctatgaagaggaggagccagcgactgattatggagtgaaggtgataagaaacgtgttcgcggatctaatggaggcatcatatcgtgagaaaccaccggttagagcagaattgcgttcgagacgagtactgaagtttctgactccgcgatcggccgggcgaggcgcgcataccaccgttagcggtgagattgcgatgccatgcatggtgatcaaagacgacgggactgccgtacctggacacataaacagaatggtgagtgctaaattacatgacaagcgtggattctttctaagatatccacatgattcggtgctccgtagcgcggcggatgatcgcaggccatcaaaactcgggtcacgcattgtaccaggagggcgaccggtacgtatcatcttcccagtcccgcttgaaccatatctgcgtatgtacatggcacaaactccaatgaatgcggaaatgggaggggccaacaacttgcccgccactcaccctctggcccagccgggaggtgggaatgaacatgtagctccacatgagggattggctttcttattagaggcaactggctccggtcaccatttgacagtcgcggctgatttcagaacttatgacgctagtcatactagggaggtgggtgcagctgaacatgagggcatgttgatagggctacagcggcatcgtcttaacttgctgccatattcaacggaagaaacatggcttaatgactctttctatcaattacaagaagcggcatatccaccaggcggtcctctccattcatacattgttacgtctcaagatccatttccagcaccaacggtagagacggatatgttatcctccggtgtaccgaacacattcacgtcgaacacagggaagaacatggcgtttgagcaaatttgcgatgaacgaatagctgagttagttccagacgatatggttaagccattacgtgtcactggtgaaaagatgggtgatgacaccgtacagtccatcatgttgtcgatggggttcaaagagagcgaccttccgaagtatgtagaaattgttaagaaggcgatcgcgtatgctgcgaggcaaacgaaaagtattgtatcttttaagcgactgatgatcagtaccatcagggcggaacataaaaagatcggagtcgtcacgggacacgcgctacccaattatcagatgcaggtcaatttcagtgagaagactgagaactgggattggcccattttccaaaaggtatcaacgctaattgaaactcttcaaatgggtatgacacgttacgtagatcctgatgccgtgtttgagtacatccgagctttacatccactaatctctgacatcaaaactgaacatgatccagatcgctcgatggccggattcgtaatgcatgtttcgccattcgtctggttttgtacttcgggaggggggttgaatgttgggtgtcccattcttccgcgtgggtcacgactgtataccgatgaatggtttctcgcccatgataatgcttttcgccgtatgtgcaaaaccgctgctacagacagtgtccggaagcaatttgctgaagacaacgcacggaatcttcagatcccagcgtccgttaacacgccgccactagcacccgcagacagagtacaattaaagaacctgtcaagcagtacaattgagatgatgccagaatattctggacaacatctattcgggaaagccattaaagatctcacgttgcgacccatcaaccaaatgtcacgaaaccaacttcttaattcggcatttactggtaagtgggcgccagcatcaccaatgcgacgcttcaaaactaccgttactaagattgaagtggcgccaatgtcgaagtatgatccatatccaacggttgatggcagactgagggtgatgtataggatgattgggctatctcataaaaatactgcgtttgcagaccctgcacaatggtttgaccgtcagatggcagagcatcccagcgacagtcctggacatttagatggatatgatgtgttgaaaattttccagactgaatctgatgcgcactgggatttggcactccgaatggtaggatttggttctaacttgcgtcaaatattcgtcacgcgggctgctaacattaaagcagccgtagagatgggtattggacaaacaggctactatgcgggtccacttgcatttatgaacatgagcgcagaccgtctgtcggacatgactgatatccctaccgcacataatctacatcattcacgtgaagcacggatgtacgcgtcgttagtcgcagttgaccacgcgtggaggaacatagtcgacaatagaggaaccttgttcaaggttagggtcattcccgatggtcaataagcacttgatcacagaattaactgagacaggaaagaagaagaagaagaagaagaagaagaagaagaagaagaagaaggagaagaaaaacgaatatgaatatgaatatgaatataattataccgtttcgcttaacgagcagaaattaatatcatagcattctagactacttttaccgacc

SEQ ID NO: 533 - DNA, 1578 bp, Unknown
  derived from dsRNAs of unknown virus
gaatattgtaatgctgtctattcaataacatgaatacgctatcctacgcaaagtacagtgatggtgttaaaacgcatgttaatgcaaagaaattatttaaaacaagacaacgttcaattctaggtgcatttgttgttgcgtcatcaaagacgacaatcgacccaaatgcattattgatgcgaaaggataactctcgaatattcaatgttgatgaagcggatgtactgctaatgcagtcaacacgtggatacacacgagataaagttatagcgtactacgaggctgtgactcaaataccgcaagcatctaaaaacttagccgcgtacacgaatttgaaacatgatccccctggcacaatagagccacgcgaaatgacgaagttaccgaagataatttggtacgcgaactcatggaccggtaattcttgggtgcaacatttagtgaaaagtgacggtggcgtaccctgtttttggacgaaggatcatactgaaatatccgatccatttagtaaagcgtggagaatttacgatacaaaattcccgatgagaggatggagaataacgtatgacgtacacaaaacaaaagatcatgtcttcgagcaactgcttaagtttttggagaaatatgctgatgaacctgtagtccacgtgtggatacaaggtacattaaaggatcgtaacccgaagcaaaccgttgacgatctaagagatatggttacttctgaatcagcgtcatacgctgatggtgaagtgtcgaataacatgattccacgcggtacacaaaagactgctgaatacatgtcactttgggaaacaccactatcggagacgcaagatttatgggaggcttatggaggacgtgccccaatgcgtattccaataatcccgtggcgcgtctcaaatctaggtccgagagcttttcataaaggaattcctccgcagctttttccatcttcaactattaaaacagttatgggaatggataagagtgatttacattttactgaagtatattgtaactatagctcttttgtggagatgactcagctaacggaggatgatgtgaaactacttgactacggatggatgccagttggagcgaatctgttcacaatggccccaattacgaaagataattacactcaccttcttaaggtgaaggacccggacttctttagagggtgcggatcagttgtgacatcttcgcacgcgtgtttcggactcggtagaactaacgatgagttattatttcaacatgaacgaaaagtccaaacaggtcatggaacatcaggacatatgattgccagtgtactggcttttcaaagtcaattcctatggtacctacaagaagtatttgataattacactagcaataaaagcgtttacatagccaaattcagagaaccggaatctggcgtgtatcacacgatacatgagtacaggaatgccattcatgatatgaaacggattgatagtaacaagatatatccaaaatatgctagaaacaattttgagatatgcaaaaagttcgttaatctgctaaaagtttagtagggaacagcggtgcatgaacatcatc

SEQ ID NO: 534 - DNA, 1042 bp, Unknown
  derived from dsRNAs of unknown virus
gaagatataactggagttcgcacacgatggagggacccggaggggaccatggtgctagggagaatcatttcgtcgatacggcggaagctctcaacgcaaccacccatcgagacgaggtcctgctgcatcttaagatgacgcgcgatgcatgttcatacgcctacgataagttgaataggtcaaactctcgttggcaacaactgattatggttgtcgcaacgactggagccttctcaactgccgttctagcacttgcggacaaaacgggctggccttttgagctggttccgattcttgttcagacagtcgctggagcaatggcagcttggattcgattctacgactttccgaggcgtatggaagagttaatcaacgtaaaacatcaaacgagtgacattcttgagagtgttcgtcaatctgcagcaatcactgatgaaatttgggctaagtacacatcggctatcactgatgtggaagacgttatgtcaccaatgctctatgataaagcacacaaagattcgacgaagactttgcagcgtggcctcatccgtgaggcccgcgttcgcgagctgacaacattgtctgatgagcagcttgtccgtaaaggggctaggccgttcaaggattcagacgaagattcacctctgttctcatctatggcaagtgctggcactctgtcacccgcgcgccttggtcggcgcgtgtctgacccgaggccatcattcctttcccccgttccaaagcgtgcgcgagctcaccgttcggcctctaggccgatacccaaacaggcaggcggtaagcgcagtccttcaccaaggcgtgaatctgacggtactaacagtagcacatcctcgaatgcacctctctcggcacctgctggggttgtaagttctagcgatgagttggatgctgttgtaccagtcgtcacatcagtgtcgaaggtttagacgtcttacttaacgtttggttcggtgtcgatcaggatcctatatttcgctttgcactgaggggaatggggaatggaaacggaagtacaactatc

SEQ ID NO: 535 - DNA, 964 bp, Unknown
  derived from dsRNAs of unknown virus
tgagtgtagaggggtagacaggaaacaggcggaatcggtgcgtcgataggtgccataagcgagaacggactttcctcggtacgcttctgggctgcataggaatgggaaatagaagcggccccctgtccctgggaatgaaggcagtcggagtcgtaatatttggcgttatcatcggcatagaagatatccttgagcatgttctgctgctggccctcgttggagaaggtaacaacgaaataccggccgaaaagctcctgggatttctggtcgccgtacttgcccctggtgccgtagtacttcaaggaagggcgtaggaagaggacctcggcgataagcgggcggaactctttgtactggaaggagtgctggatggaacgtagaaggacccattcaggagcaccatgcggaaagtcgttggtcataaagaggaagtgcacgcggaactggaagtcggtacagagcaattcgcaaagctggttgtagaagtaccccaggaaggcgttggacaaacgcatctcgattcctttgaggaggatattcgggccaaattcgtcgaagagttcgcggagcggggtcttgcaaccgtagaagcgcctaaggtagtcgtaggtggtgtccgagtcgataacttcccgtgggcggatctgccaatcgataggggcaggctgggtctctgtaagaagggccgtgacttcgaggtgtttgaccagggaaaccgcagcaagggggtcgatgttggaatgaggaggtactgggtcatctgcttcggacttggacacacagttggcaatcttctgggcgtagaggccttcatactggtccctgagggcattggtgcgggcataccattcgttacagatcgtgtagagctgggtggaaatagcctccaggtcgtcttgcgagatggcctcgaagtgagggacgcaatggggcatagactgtaggaccttatcagggtgtaggt

SEQ ID NO: 536 - DNA, 809 bp, Unknown
  derived from dsRNAs of unknown virus
gtgcaccctgcgatatgtccctgtatagatgcgaaagaggcttttattaaagtggctggatcttgggctgtgctcagagatgcagattctcggtggcactacgataaaacgctaaagagcggcggcgctcggcgaggtacgggtattttcgagatgtttggtgctggcccccagctcaatttcgacgaagctcgcgccatgttcgccacagaggtctggatttgttgcgagtatgatcttacggctgcacgagagcactgtgaatctcctgcaccggctgacatggcagcaggcattcctaatcgggactgcggcggcgctggttttgagcatacactggaaagagccagactgttgctgcagagggagcgagaatgcggcccaatggttgaagacagctttgcttatgttggcggtgtgttagaaagctgcacgagttatgcggccagggctgttgaatctgcgagtagctcacagggcatgggcttgtcggaatcattagagtatgctgccgatggtgttagctcctatttacagtttggaatgcaactgggtatgcagctcagttgtgcccgagagtcacgatatgtgcgaagcactgtattggagtatggtattggctcgtgtgacgacgaagtccatgaaaatgaagatgaagaggacgttgatgacagcaatgtgagcgttggagtcaaggatgatggttccagttgcagtttcagaacgccttgtgatatggatgagttttttttggaacaggacgttggggatctgaatgaagaattcggggtgacggaaactagtccggt

SEQ ID NO: 537 - DNA, 742 bp, Unknown
  derived from dsRNAs of unknown virus
agagattggagaggcaacaccagctggattcataggtaggatgagaatatcgctcttgacagtgattaattgcttatcaccattgtcagaatgtgaagtggagtgcattaaggctcaagagggagagaatcaatactgcataagtgcaatgttattgtggatgagaacgatgagcaaaaaaggaatgcatagtgtggcctgcacagcatgtcataagaaacttagcgcatggatagatgaagatgtagtcgaagctgagcaaatagctaggagaagcggatatgtagaaggaggtgacaaaggtagttacgtttatgttgcaagaatgaaaactctgatgggcagagatctaagacaacatgatatcgaggaagaacataaagagagatgtactgtgtatgattgtcatggctatacaaacgaaggaaagtttgagtataaacaatggaactgggacatgtatcaagaaatgaaaaagctagtcaccaaagcattaactgctgattttggacgaggacaatctaaagataaatggtcaaaaacaagagggttatggctaacatcgggaacgacatctcataaaaaagatgagttggctcaaactgaagacggcaaaaagaagaagagactcttcgaaaaggcgatagagaaagggtggatagtttctaaaaatgcatattgggctgatagagaactagacctagaagagttgcttagcaaagaacctaaaatgatttgtagg

SEQ ID NO: 538 - DNA, 505 bp, Unknown
  derived from dsRNAs of unknown virus
gagcaatacttaggaaatccaaatcttaaaaaggcacactcaaaatctcgatttacaaaaaaacaaattgaagaagttttgaagtgtttggatgaaccaaaatattttatagagaactacttaaagattgttacaattgataaaggtcttgtaccttttgagatgtatgactttcaacgagatatggtggatacatttcacgcaaatcgtttctctatttgtaaactaccgagacaaagcggaaaatcgacaatcattgtctcctacctcttacactatgttttgtttaatgacaatgtaaatgttgcaattctcgccaacaaatcttctacggcaagagatttactgggcaggttgcaacttgcatatgaatacttacctaaatggatgcaacaaggagttctcaactggaacaaaggttctattgaattagagaatggaagtaaaatcatagccgcaagtacttcttcaagtgctgttcgtggtagtacatttaatattatct

SEQ ID NO: 539 - DNA, 12813 bp, Unknown
  derived from dsRNAs of unknown virus
gaaaatgtccgagattgtagatagtgtcagcgatactacacacaccatgccctccactggagggcgacgaaagataaaaagagagaaaattaattataaatcatatagatctaacgtacgtaacagtagattgtgtaagttagatccatcagcaattaaaataacacaagtaatggttccaagtaaagacatacctgcacttaaaaagaaagattttcgacacaaagataatcaatatatagatcaattctatttcagtactgaaggagagtatactggttcgaacatgaacttgactggtgttatcgaaattgcacacaatgtagcacacaaagatgattttaatgcaaatttcacaaacgacagagttttatgggagccactccgtaaaattagtgggcaatggcaatttaatgaacacactaaatgcaaagaggtcaatgtaccatatgataaatacagagcacagctattgagagaaattagattgacacgaccgaacggtaaaggtgatttattgtcatacatatctaaacacacaacgactgcacaatcaggtctatacggtagattgttgcatggtgaaatggattgtcatcatggtattcagatacattgtaagaaatgtaaagctattagtgcaataccatggccattattgtcatcatacgtaatatatgatgagaatattggtgcatatgtgaataagaaagaattaacgaaacagaacgtatgtcacattattgagggcatcgaaaattatgatatattgaaagaatacgactttaagtctgcaacaatacatgacggattgaaaggttctttacaatggtgttataatgcaggcagtgcacactgcttcaattgtggatggcatttgtcagaaagtatcaaaatagttcatgcggttacattcactgtacaaacaataccatacaatgattatggcattaatgcaatgaatttagaggaattcgaaaaatgtttgcatttagatacaccaccaccacatgaattaagtgaagcatataccatatataatagcttcaaaaatgcagaaatatcaaggatattagggaaaatggaagttaactttatcaacatgtggcataatataaatgtcacatctgcaacgtatacatcagaaatgaataatataaatatgatgtcacgacagcgtttgacaaactcaacaatatcacaaatggaactagatgaaataaacatagtgtcacgaatgacaacgttgtgtggtggtgacatgtcatgtgaaccatcatcaattgtaactttacattcattgcatgacttagtaaatgtttaccaaacgtctgactggtttacagaagcaggaatcaatgtgagtacagaaaacaattacaccgatgtgacagtatggtcagcgcatggtagtagaaatctcgagtttttacagccaggcatgtatattttacatgtaaacactcataattgtagtgaaataaaagtgctaaaaacaaaactgtataacgcggtaactggttcatcaataccagcatcatggtcaaacagtatttgtacatacatgtcaaataattcagcaatcaagttgaacgatgttgagtatccattaataacaatatgtaatattggcagtatgatgattacaaaaataggtgaattgaaaacgaaattgatgacacgtgtcatacgtggttcatcaaaaatacaagtattcctaccaaaaatacatttgaattctatattccaaacgttgggcattataggtacaaaatgggcatatcagactattgatacagagttgacatatagaataattgttaacgcaatgagtggaaagaaatcgattgattcattacttacatacatcgctggtttaactgcgactagatatagtgtaggtggaacattggtcgacttaactaatataagcattgtcgacagcatacctgagttaacatatgcactggtactgatgtcagaacaaaagaaattaagatcatggtgtagattacattacataaatattgacgcaaaaaatgcatcaatgacaatatatgatatactgctatctaaggtcttatcattattaaagaaagctagacctaattggagtagtgcaatatcagatatgttattaacaaaatacgatgtatattttaaacgtgacatgatgacaataactacacatgctactgcaaattttgaagccatacaaccatttaagtttattagaagttgtggaaatttcaatactttaacatgtaatgcagtgtgtacacacggatgtgatgtagaggcacgttcatgtgatgacggctgtatgtgttgtggcatatcatgtggcagtgatacattttgtagtaaatgtagaccagcagaacaacacacacttgcatgcaaccacaaaattttgtatcaaaagacttatagctgtgaattgcgtacgcgcactggaacatgtagtcacaatgagcgatgtgtatgttgtaagcgtagaatatgtacagatacttgcatgaattgtttttcagaatttgatgatatagtagatgacaataaatttaacaataacaaatttaataacagaaaacatgacgttaatatagtgaatagaaaaagcatatcacatagttacacaaaatcaacacacaatggtagaaaaacaacaatgtctaataaatttacacctggaacgaaacgtaatgtaataaaaatagataacgaagtaattagattaccaagtcatgagaatatatcgacagacaattttatacactactcacttgaaggttgcccacatgtgttatccaattgcattacaggtagtcgacaattagcagtgagtgtattgaacaaacatgacattgaatcaaaaattgaagtgactaataaatgtctgctacattgtataatgcgtatttttaagattacaattagtgacatggaatcagtggttggcgcacgtgatggtcacacaatattagatttgagagcactgtgtgagtattttagattaaatgttattatacaaacaactaaaacgaccgcggaaataattagatatggcccgatggaagaaccatatggtatgatcgcacacacatctgcattcagtagtgaatgccaattaagtgcaaatcattggtgtacaatacacaaaatatatttaacacaactaccaatgggtgtgtggacaaacgttgactatgcaatgtatgaaattagtgacttaatttcattcaattcattgcatgatgaacagaaaatagtacatgcagcattcaaagcgattagagatagattgtcaaattcggtgttgacaggcatggaaacacctaaaccattagcagttattgagaaagatggtaattattacttgtcaaattcatgtacaactaatattgtacgtggtttaattaacgtacgattacctggccattgggtgaattatgcaacggatgcatttgaactagattttgtacctacacgtttaatggcaataacagcaagtgtgtcagccgaggattccattgaagacataattgatgaagaaattaattcaattttcagatcgattgccatactacgtgaaaattggagaaatggcaatgggtttaaaacaaagattatatgcaacaatgcacggccaatagttttattcgataaagacatgaaaatatataaatcacttgaaatcgttaagttaaactcatctaatggtgacacatgtctacaattgacaggcaaaaccaatggacaatgttttgttgacaatccatatgggaaagatttggcatcaattgaaacaacaactgcatcatattcatcgatgattagatcaattataatgtcagtgaaagctcacagtagggtgcaaaattaccacagtgcaacaattgatacatgcgtgcaaggagtaggtggatccggtaaaacatggagagtaaaacagttatttaaatcaaacgtattgtttacataaatttagcagaccaataagtgaactcaaagatgaaaatccgggatactcatactcattagaacaagcaacaatgttcaacttggattatgatgaagtaattgtggatgaagcaggagcgtgtagcattgttgaactagttgcattatgcaataaaccaaatttgactctacacctcttcggtgacataaaccagatcacaacaacggatttttcaaccacaccaggtttgcgtgaggatttaaacgtgttaaattatcactctgacaagctagaaataatgaatgaaagcagacgttacggtgaaccgtatgcatctaacatattgtgtgagctatatccaaatcttagtgtacatgaagacgtaacatggaatactacgtatgaactgattaaaagctatgaaatagatgatgtgttgaaacatttaaacacaaacaatttcgacatgatagtaacatttcacaatgaaacttacaatttattattggacacatacactggtagtggtaaaatagtaaaggtacatgcagatcaaggcgctgaaggtgatagagtagcagttatttactggtcaccagatggtagtgtatcaccaagaggtattttaggaaatattaaatatataacaactgcattgacacgttgcaggaaacatattgcattaattacaaacatggctattgaaaatttcaatgaagttattggattatccaaatgtggaaaaggtgatgtgcaatttttaaacccggacacattaaccattgataacccgttagatgacgcatcaattaaactgttgactgaagtagttaaaaatgtactgcctgactgcactttagagtttaatggtgaccaagaaattacattcttaggtgcagttaagaacgtaagtataaatgtaacgttttcacactgccaaccaattggaaatgacactaaatcaaaagtattattaatgacaggtaagagttatttcacacttgcatttaacaagatcaataaagagtgtagcaagatattaagcatgttaatggaacacactacgcgagtatcaatcgaaacgacaaacatgaaagataacagtgatattaacgcatttatttgcatcgaaaatggcacagcaacaggcacaattgatgacttaactaacaacgaaacagagagtttttacacgactcgatctgtagcaactaattcatggtcaattgagcacgatatgaatatagcaacacacatacccatggtaatcaatgtagataacacgaaaaatcgttcattaccgactagtcttagtgatttcatgtccaatgcaccaccaatgttacagtcatacaagttggtaaaattaatgtggaagcggttaatatgcatggcggacgtatgcttgattaatcagaaaaacaatggaacactaaaattaaaaacaccaatggggaatttgaaagtaaagatattcgatgggtgtagtttattttgtggttttaaatttacatttgaaaatggtaataatgtgattgttagtagtgcacatactgaaaatacggaagatattgtaacggttctttcatgtcaagtacgttcgtttatgggatcacgtagtgatataaattgtattgtcaagtttctaaatgatccactaccaatttatctaccatgcaattttaacaaaaatttattatcaagaatgtttgaacgtattagaacagtgtcacatgcaagactatcacaatgcggtatagctaatggggcacaagatgcaggtatcgcatatgaatcacttaacacagtagtgtatgacaactttgaacgtgaacatcaaccacaagccagaattacacaccaacgcgtaacaaaattgttatatacagtaagcaatgatacatatttgtatccagataaaacattagttaccagcataaatgatgttatgtcattgatgcgtggaataaatgcaactgaatcgaatatatctgttaaaaatgttaaaaagatggacacaataattgcaagaaaaatgattgcattagaaactgaacgtaagattgtgaccatgccgaagtcattatggaatcgatggaatttcatggtcagtgacaacatacatgacaaaaatgtaattaaaactaattcaaatggattcgatgacacaattgcatgcatgtttgatgcaataaatatggtttacatgaaaaaggtgttgaagttaaattgtgttgacgtgaaatgggttgactcatcaatactacatttaaatatgttagaaaattatcgtattttagacagcgaccttgaaaatcacgaaaaattatacttgtcaaacaaactgacgaaattaattgaatcactatcacagactgcaggtatggcaaaagttgataaacaaagaaatgtagacaaatgtgagcagttaaaaactaatggtgcattcatgagatcaggcaaattgtcaaatacactatatgcatcaattaatggtataacaaaaattgacgttgacgcatacgaaaatatttacgcgctaattattgactttagccatgaatacatggcaacagaaaataggaatgtattcatgaaaggcaacaagtttcgacaatataatatggatgaatgtgttaaaaagtacaattgggcaacaatacatacaattggtatatttaagttggtcaaattaataggcataacggatgtacaagttgtgtggccaaaacagattaacatgctacaacgctcattctctattagtggtatatctggcaaattattttcatttccgaatgcgatttttaaaaaatgcatgagtagagcaacagtacccggcacaggtgttgatgacatgcttgcatatctacgatcagtatcatctactgttgtatacactagtgcaggcaattataatagattcaaaattgatttagacgatatgcatatgttgtcactaattgttgtaaatattgcaaaagcacataagaaatattttgacacaatgcattcattcttacatactaccgagaccaatgtgctgcatgatttaatggatataggaataggcgcagcaaaaacacatgtgattaattggttgaacaattcaggtgtggttgacttattgaatgcgtatactgattggttgactgaaaatgaagatggtgtgcttgcacgattaactgccatgtttaaagatgcacatgtagaagaagttcaactgtacccgaaatttgtgcaaaacaaatatgtatgcaacaacaaaacagtcagcttcactggtacactgaatgacggtgccaatgattatagtaataataatgacacacagtgtggcaagaacgccggtgcatcaaaaagtagtgtgacaaataacaatgatagcaaaataccagaaaatgcagatagcacaaactggcctagtacgctaagtgacatatgggatgatgtatataaaaatagggcaacaccaactagcaaatcatcaccacaagacagcatgaataatgataatagacatggcagtgcagtcaccattcaaagatgtatgcgtaaccactttgtaaaagtaaatggagtacataatattggatgcattacgtgtccagtaatggagaagaaacaattgattaaaattaacaatgcactacggtatatgttttttgaagtaataaaggtgttgcgtgaatataaactagactttacattggcacgtggcacagtgttggcagcaatgtattatggccggatggtttactttaacaaatacggctttaaacattgggtagatggcgatgtagatattatagtatatacacatgatgatagtttaatgaaaattgtattcaataagttagcaaaggtgttcatgtgtaaacaaatgcaaagatcaaatggtagaatatgtgctttcttgaaatatggtttatatggtgatgtgaatatggaaaggtgtcctgacgtgcatccacatcatgcgaagcgaaataaaataatgtcacatacatgtattgacattgcatttgtgaaatgtgataatgattttattcacattgatcacaaagatatgtcagaacaatttggactaccaatggggcgctatgatgcgagtaaattgtggccaacctatgatatgggcataaagctttatggtatagatatattaatgccgaaacaatggtgggcaacattgtcatatactgcaaacatatataaagatggcaattatgctgcactacgctacccatggtatccaggtattgagacagcaggcagtgcacgttgcaagtcatatgcatataaaggtgagtatgacatacaacgcaattggttaccgaaatttgaactattacaaatgtacgacaattcagttatgcacaaaatgttcggctttaagcaagatactgccttaatgccaatctgtagattacgatgcacagtagcgattgtaatgggtggcagcatgggtgacacgcaaccactattgagtattatggaggtgttaaatggcttttgtgaactaacaatatttaaaccagaagatgtacaactgcccgaatgttataataattgcaatgtaatacaatatgcaaagtcatataaaggaatggtacatggatgtaaatcgacatcaggtgtaatagcaattgtgactgatagtttgaagaatataaagggtacattcgattacactgtttcaatgcattttacaagagaacgttatatgttaaaatgtaacataaagcatgttatatttcacccactgttagtgcctgttgatggtataatttttaaagcatcacaaaaattgacaagtgtactattacattcaggatcaacggaagagcattacaattgcgtattgaaagatattaataaaacagaatacaaaaatgtaggatatcccataaactcaactacatttgaaattaatgaagcaaccgataagtacttacaattatatcatcaaaatagtgcaaagttcacattgataacattaggttcaatgggcaatgcacaatttgaaacaatattacaacgaattatgttaacaattgacacaccgatattaattgtaagagggaacaatatgcaacacttgagattaaaaacaaaatgtggtgcaacatattcgggtgaaaaagatcgatacaatccaatgttaactgtcgttaaatacataaattacaacgtgataacgcaaaccattaatgaggtgtattgtcatggtggtgcgggaacagtacaagtattctatgcaaataatgttagggtacacttttatccacaggcatatgatcaacaatcaaacaagctttggtatgacaaacaaaaaccttacaaacattttgacgcaaatattgaatggaattactttaggaaaaacgtgggaaaaatttttggtgcaactatgcaagaaagaaaatacaatgacacttcaaagaaattgtacaccggccatccacatataaatccacaagcactattgttacaggtgtacacacaaaaagcgactgtcaattgtttgtgcaaagttataacatctagtgattgtgtactaattgcagcaatgaaatgtttaggtgaaggcacaatggtctttgaaaggttcaaagaaatatacgtggcatatactaatcaacgaacggttaataatgttgaagacgtaatgtatttaataattggctcacgtgttccattgaacgtatacgacatgacaacatcatgcctatacactgtgaaaattaatggtaagacgaacaaacactgtatgataataaataatgaacacacacacatgagctttggtgaaagcagtgatgaaacaataattaacttccaagacggcccgacattcatgaaatgttggaatatgaaattaacaatgccattcaatgaagtaaccagagaaatgtacaatgtactaaatagaggtgtatgcaaaacacagttacttgacccagatgtagtaagcaccattaaggcatcattgcgagctgatttaaaatctaaaatattgacgattatgcgcacaaaggatacattatatttattaactggtgtcgcacacgaaggctattattcatgtaatgagaattatacccattgggcaacttatgtatgttttggaaattatggtatggttaactgtatatatttaaaatgccaaacaacggatggtggcgtaatgtatcatggacataagttattacataaattaacattatgtgtgaaaatacataatacaagcttatcacgaactctaagaaaaaattatgaaaacgttaaggacgcgaatgttgttgcaattaaccagacaacgaaaacatattgtgaatcaaatggtattgctgtgcaatttgtgtcaaaagaaaatgcactaaaactatatatacataatacatggaataggaagcatcataaggaacgtgaacagcactgcattagaacagcacgtgtgatatatatgggaacacgcaaatgtacagaatatgaagttgcattattaaagaagaaatatggtgtgagaattattgtattaaaatcgataatgtatatgtgcatagaaccaagtaatgaagctgacggtgtgcacatacgcaattggttacagagacaaacgatgttcaaaaaatatgaaacaacagaactatggataagtgacaaattacaaattgtcgagctaatggattcattggtgaaggcgaatgactatggcatgcatattttgaggcaacaatcattatcattagaacgtacattgacgttgaatgatatactaactaaatgccatattgatccaatgggcacagtaattagtgcattcataaaacaaatgggtagagataatttaggcgcaaacgaactaatgttagaattggatgaagtaacaaaatttgataagggaccatggaaaatggtagatgcacaggaagtacacctggattatccatatgtgtttgtaaaagacaagttattatgttatgggataattgaatatggttatggtatcgatatggacaaagcagcaacagagttttggaatgacaagccaataaagtatagatcaaaagtagatgataaatttggaatagtaacggaacaaaattcagtgttgacaacattatccagacaagtaattgcaaacgtgactgcattttcaacaatgccagatgaaaatgcattagcagcatttgaacatgcacctgaattattaacagacaacaaagtatttgaattcgtggaatcaaacaatggccaatttggtataaatgtaacaccgattgatgaagttgcatctgccaagacacaagattactggcaattattaccatacttacgtgacccgattgcaataatgccaacacttaaaaattttaaagttaaatcaagattacaacctgggcaattggcaataaaacggaaaatacgaatggaaatgtatccagcatatgcaagaccatcaatggcaagtgaagtattcgaaacaatgaacagtgtaacaaacagacaaggatctgtcaaaatgtaccaaaaacatgtaggttcagcaaagttggaatttgaaatgtttaagactaattatttccgtgatgattgggaaacgttagttgcgagttggaaacaaaatccattgacaattaattatgaagatagttacaaatgggctaaagaacacagttatccaaagatggtaatgaaatcattggatgatctattacgtgatggttttgagatgaatccaataaatgctataaaagtacatggtaaagttgaacaaacgacacggctaacaaagctgagtagatggatgacggaagtgacaacacgttcaatattagcatcatcgtattgcatatccgcacttttctgtcctctattcaaacaatgtaaagccagatttaaggaaattttacgtccaaagattgtgtatacagatggcatgtcaccaatacatatgaacacgcatgctaaaacagttgacacgtttgattgggtaatagaagatgacttaagtaaacaagatgctgcaactacacacttaatcattgacacagaaatgatgatatatgagttgctcggtgttgatcctgcagatcttgaaatgtattcatggatgcatatgaattggcgctttaagggtaactcaatgagtggtgtatgggacgcaatgagattatcaggtcaaccaacaacatcattgggtaatgcaataacaaatttgatattacacaacaggtttatgataagaaattcacaacatatagtgataatgtatttactcggtgatgacaatataattggcgcaaccaagcaattaaatgtgaaacggcatggcactgaaacacaggacatttataatattgtaagcaaaatcacgcaacaacgttatgttggtgaatttacatggctactaatgcatacaatcgatgatcaagtgcaattctgtccaaattttaagcgcttaagacaaaaatttggagtgtgcagttatgcattcacagaagaggaacgcagtgaaaaattagagatgagaaaactgtcgtatgcgttgatggcaggtgcatttgcaaatagtacaaaaatatgtaataaatttggtgtacggtgtcctgattggttcgacattccatcagcaattgaagcaaataaaatataccatgaaactaccactgaggatgtacacaatgacattgcaatgctgtttggtttaatggattgtgattccatacaatatgaacatgctgagtggcaaaatgataggacagcaataaacagacaagtaaatttatcaaatttagaaaacaaattcgattaaaaatcttataaatatctttcgaaaaccc

SEQ ID NO: 540 - DNA, 7546 bp, Unknown
  derived from dsRNAs of unknown virus
gaattttaattttaggcttataaagtctacaagcccgcgtaaatacgcttgttcaattttaaaattccagtgtaaagcgagatcggcacatacgtgcgtctgacaactttagactgaaactcgttcacgcgaaggcgctgcaatagcatgtaggttaccactaagtggcaagacttggctattagtgagcgcgctcggaagaacatcttgattcgaaaatggtggtgcgcggtccattctagaaacaagggactacttcgagaagacacgaaatagctgaacatcgaaagggagggagaacgtaggtcagacttgctcttaatctttcgataattaggtaaaacttcgttccataaatggcaatttcgccacttctaaggagaaacttatgtctgcattgatcggagatgttcacatttctcgctctgtgttcaaacagattgaagagattcatcaacccaacgacactgtgaggcctactgccaaacagatcaccgacatgatgctcaagaatgtagtgagggcgtttatcgacgcaaaagtcgacgaacacaagtacttcgatcctgatcttttccgggctcgcaaagtacccggagagatgaacgactacgttatctatccgaaatacagtggggtggcggactggatggaatccaggttcaccatacccgttcgagtggtaatcgagccgtccaatcgtcacaacattattgatcgtgacaacatcgatagtatgaagtctgcacaaaggctgctattcaaattcggactgtcggctcgcgcgagaaattgtctctttatggcggacgttttcgcacttgatgaactgcagaatcttactgtacaggagttcgttaatacaccaaatgtggggcataaaacgctgcaggagatcaaacaggccatgtgccgattcgatattccgttctcgaaggagagaaagtacgtacctaggcgtactagcctccctcacaaggatatcaatggtctctgcccaacatgtggaaacgacgtcggacatggcacgtgtagtgtctcgaaaattgagggaatcgattgatgaaaacctcggcattcgaagaaatcatcaacgtcatacctggtcgctgcttcgtctccgacaagcggaaccaattgggtcacgacatctatctgaatgtcagatccactccgactgatcttcattttgtgcgtcgtttcaacgacgcacttctgcacgtgtactgcgaagtctcgagccactcggacatcgagaatcagtttccgacttaccaactaggtaaagttgaaattaaatacacgtcgagaggtcaatgcccgaaggaggtacgctcagcgacgaacgccgagcgattaatcttcattatggctaaagacacgattttcaaatccttggggattttcgcatgactagtcgagttttgcatgaaatatctgaagaacacgtagcagagattatctctgctggcactacgaccctctttgtgaactcaggcggtggtgatattaactctgcacttgttttgttacactattgtgaacgtaatcaagtaaaggtgatcatcgccggtcagtgctcatccgctgcctgttatctcctcgctttgtcacgccataacgtcgagataaagactcacgcatacggcgtgcagcacgcaccgtcaactctgcgagacccgcagaataactggcatggtttcgatgattgtggttttaaggctgctcatcgacagtggaatcaggataagaaggtgtatgaagaactacttgatcgcgagatcagcgatctggacgctttcaccctattcgattaccatctcgcaacactcgtagacgagggtaatctgaggaaagtctacttcggagatgatgtatgctagttgtgcattgtcctcccgcatccgggaaaaccttcctcaccaagaaataccctggtgttgtttacgacaacgatgaccttctggaagacatcggactcgaaagttctcactcgggttttcttgccatccaggatagtaagaattggcaaacgaagtggttggctgcgtttaacaaactggaaaatgacggcttcaccattttcacaaccaacatgaatgtacaacacctgtgtggtgtgcagatcaatctgcgcgctgcttacaaaccgacggactacattcgtcacgtcgaaatgagtggacgtaaggacctcctcctcaatttcggtttcgacgaactgaaatcttggatgtccgactacgtttccgccgaaaaggagttcggtcttaaggtgcactggatgaaaccaggacacttcattgacgaactgatcttttaatctgaccgaataacatcaacgaacgggcatcgcccgctctgcggagaaaactatgcaacacaatttgtgcacaaccgttttcacgatctcgtatttcgtcgactcgtacagtcacgttatcaaacatcatgactctgtagcacgcaccagctacgaagccgagatcgaagtaatcaatcacgtgttcgatgaattcggcaccacacccatcatcgttttcgttgtcgaccaaaatggtcggcactacaacaagggggtgaaccgtgtcgttatttgagctcgaaagagacacctacgtcagcctgattgagctgcttgaactggtcgtgttccaacggaaactccagtttccagacattatacgattgcagaatggctgccatccgattatcgatctgcagtttaccgactgcgggcaatacgtcgatatatcctggaggccgcatgcttaattacgtgtttaaccacgcctttctcgtcagcgttgctggcaacggagaggatttcgtgttctacgcgcgactggataatcaccacgtcgctcggttcaactggcactcgtcggaacgaactgcgagcgtagaagtacgcactgaacgtgtgctcccacacgtcggtgacgctgttgtgcagctaccactgcaccaacaatctgtcatacgacgagtaatgcacatctattcacaacgtttcactagtaattcggtagcgaaagaccacaatctgtgggttcgcagcgccggagattacagtgaaggttcaatttacctttggatgtagtatgactaagcacgttccattagtatgttgtttggacaagaacgcggtacccgactacctcattcgtgaggaaaaggagcccgcccccaacttagcgacagacattttaaggaagtttctcgatggtactccctccaacgaaagacaagctaattcacaacgctgaattaggtgaggcgttccacgggccgaattccgtcccgaaacatattctggaagatacaattggtaaaggctgcgccaaagtactcgtccggaaggtcaacgccttcaaacgtttcaaatccaagtataaagccttttcttggatagacaacgacaccgttttcgataacctcaaccatgcccgattcgagctggaggacatcgatccacggttcccatccgtggtcacacacggagcattccgacaacaaggtgtaggagttatccctccaaccgcaccagctcgccgagaattggggcttatcgatcctgatgacgaccatcagacgatcggcggtgaaaagattgattcactgttcaacctatgtctagatctcgtcatcgacgaattgagactcggacctatactggcggagcagcagcaaggctccgacttacgggcacacgtcgtcgtcaagaaaacgtcgatgaaaggccaccctatgtgttacactggacaggccgcttcggtggacttttcacgcgacgtactcgttccgatgtacaatagcaaggaaggtccttacactttcgcgttcaaagacgactactacatcaccctgggaagccgcgaccaggcggcaaaacaaaaattcaaggatggtgagtggtcaacgtcgtacaagttaggcgcgagattcgacagtaaggacggtaacgcggtatacatggcacccatgtatgatcccgatgataacattggcaaccgcgtccgtcatgtcgcgaacgtcccaatggttgttcaactgccgggtatgaccgctaacgctttcgtgttcgacaatttgacacccaaaatgcagatgattctgaagcatacacccgattcgcttcagaccgtcataggcaacatagttcatgcgacggatttctcatccttcgacaaaactattctacggaagtcgcggaaccggttttacgatcgcatgtactcttcggacaacgcaactctcgcgaagcagattgacagatatccgttcgcaggcgtgtatactgagcacgatgcgacacaaggcaacgaagatggtacgataccaatcttctaccttatcgatagaacaaaagatgatctggcggagcttttctctccgttggcgtctggcacgggtgacaccgcactgatcggtaaaacgattggcacggctaacttgttgcgagttctgtcaatcctcactaacacacaccccgctaaaataatagcggcaggagatccaaacgcaatcgattgtctagcagcccaagcgattcgtaattcgggcgatgattctcttacgatcatcgaccccgtcgccaaatttgccggtgtgaaaccggaagaaatggccaaacgtcacgtgcatctgctcgagacacagtcgctgttcgacctctcccttgaggtaccagcgaagttcatcgggtacgtgttccacgctgacaactccgtgacgggacgttgttgggcagtgacacacgacgtgacctccctgttcgcaaacaatgttttccgtgaacatggtttcgactctccactgcgttcggacgaagtggtgggattgtcgcgttctattctcgcgtaccggtcgaccctcgacctagttatgcctgctgaaagcgatcgtcttgtcagcacactcctcgacgtagtagaatgtccttatgacgaggaatcgttgcacgcggagggcacggaacgacttgaaaaccccgagaagtatcttagtcgacgtgtaaatgaagaacttgtcgaagaggatgacgattgggacctggaaagcgtttccgatgaaatgaaagccgagtacgcaaggaccaaactggctgaattcttcggtctttcgaaaccggatgaactagactggaagatcgaaaagaaacggctcattgaggaatcgccacccgatcttctgcagtacatcgcaattgtcgtcgatccgaaattgacgactggtgtatccaaattcattaatgtgagattctaattatggcatttgtagtttccaacctctcaacaactatggccctcatcgacagcatgctgggttccgtatccaacagtggccgtaaaactctggtagccccactagcaatccagcatcatcttgcccacttcagtgagcacatgcaacttttcatcgacaccatcgtcgaaggatatcgtggcgcatcgacgtcgaatgtcgacaactccgagttgctacgcgctaccctgaccaaccatattctcgaggtttactatcccgagattcagaagttagcacctctcattgcctcaccgaccaatctgggtgcgatcctggaatcccatgatcccatgtgggaggtagaaaaaggggaggacttcccgttctttaaaacagtacattttccgcaactgcgtgatttgcacgcgaacatgcgctcaatcctggaaagtgtcgacgtgactaacggtctgcgttacgttccgtcgtactatgcacccaagctgtacgcacacctcgaaaaggaaatgaagtcgcgtcacagtctcaaccagaatagcaagcgtatcaaacagctgggtgcgcttcttggttcggacattactgaggaagagctgacacacatcaatcaggcactgtcgcgtttgtttggtgagctcaagaagctgtccgacgctcacgccgtcaccaatttgtgggagttgatgattctgacggatcgtgcggtgtctgacacggatcagcccatgttctgtgccaccgacgtacacatgcgtcttatgcacactgcgttgtctatcctgcccactgaggtaggtgtagacattccgctcagctacgtgaacaacagcgatttgcccgaagaggacaatggtgttacccgcaccgccgacgcggtcgacattgaagagggtgtttccccgatgatcggtgacgtgttcgaacacctcctggttatcgtgggtcgcaccgcgaagcgtatgtccgttcgtctgaatgacatcacgctcccggtgaacatccacccgatctcaactataatcacggatatcttcaaggaaggtatgcgtgaactgctgccggacgttcaatccgaatttctgggccgctggttggatcttgcttcaaagggttcaaagactcccgtcaaatatgacgacttcaaagtcaagatggataacgcactgcacgtcgatcgtaacgcaattccgcgtgcgttcgacgaccatctgtttaagatggtaggttcactgcccgaggagctgatccggaagtacgttgagaagcgctcagtgtatacgtcgatgatcgaagccccaattgagaggacgttgctgcgtgtgaccgacagtatcgatgagatccgtgacaccgcgcgtgtccgtctcgaatccgatcaaccattcgcgtggtacggtgacaaggtaatccgcaaacaaggttctacgaacgaagcattcgttctgcggagcaagatcgactcaaacatcgccgtagacggcgagatggcagagggtgttgcgaaaattgtcgccgagctgtacaagttgcgccaacccgatcgcgacgacatcgataaggaattcagctacgctgaattcattcgcaatctccgtcatgacctgggtgatgttcgtcgtatcagggacattacggctaatggtgacaccgagctgcgtttgtcaaacgtgttacggggaggtgaatttcagtacaaggatgatttcgtcttgttccgtgaacatgggcacagtcacgaaatgtccatgccccgcactatgatcaggctgcaccaagattctattatccatgactaccctaacgggagtgttgcgtatggaaccatttccggcatgctggcgagtgatctcttctctcgctgggccggtaccattacttcgttggcctcacgtgtggcacgcgtgtactccgctgcacctttcgcagaagtatcaaaagatctgaatattgtcacgcaatatcagagcacgtcatatctaaaacggagcaccgaattcagtactttctactctcagatggacgtcatgaccgacgacagcgtgtggcgtttcctgtctgcaatgcagacacagaaactcgcacgcgataaggtcgacgtggaggtgctagagaaactcaaacgtcacgaactgtttgtcaacacctcgttgttgaccgacattgccaactacgcggctagcgtagcgcaaagtgtcattgataacttcaatgtcgaatcagaaggtttccagacgtttgcgaaattcgtcgccggtcgcttgactgatgccgaaat

SEQ ID NO: 541 - DNA, 7535 bp, Unknown
  derived from dsRNAs of unknown virus
cataaaataaaatcaactttagcaactatggggaggaaaagttgattttatcgtactgatcaggtgaataaccagaactatcaacataatcgatgttgtcgctgcagcacagcggaaccaaattaaatgtctagtgaaggccgttttactcatggcgtaacacttcaaaaatcaccatcattatacggaagtaccggcaatgataggttacaaaattttgaggcccagcctcgtggtttttgccgaccaggtttcacttttaattaaaaggccgaaggagcaagaaaaatacaatgagttccataatgtgtaagtcattcccctgcacgggagccaaggaggtaaagccttggactgacagttcaacagtaattgaacacgagcctttggctcaaccccataacaacgacaaacttagtagatattgcatcacagatccgaatggtccagtggtggacattttatgttgcaatattgaatgcaccttatccgggcggaagaatgttttacacattcaaccacaggtaggatctattgtgtcacttcgatgcatgttcaagctatttgaacatttcaggatcggagctgacacacacttatatgatgatgacaggtttgctgacgcggaagacgatccaacagctgatatcgctcaattacttggcgagttaaccataaatcaatcagacgctgattcgcaaattcccattgctgacggtattaaaccagaccagaatatgatctcagaatttaaattcgatgataattacattaatggattgtgttatttgcatctgctgccgttacagttgcggccgcaagccagctctcagttaggaatgtaccctacagtttcagagtttgccaaatttacttttgacaacctgaagaataagaaatataaattgtactgcgaaatcgacaccacattgcattacaatggtaaggcagggtatcatgttgataagcgagctaatacgtccgatgaaggattgttagcaacacttgagtcacttgagcaggactgggttattggtggtagtgaaaccgtttcagaattaagttcggtgatactcgctagaactagcatgtacgcagcaacaaaacctataccaaaaaccatcatgaccgtatcagtaaacttcgctaaacctggagaaggttactgctaccttaagttctttagaaaggatcatagagagaatgcagcaaagtcattaatgtcttggccgaaatctcatatggtttatgcaaaactcatagagcttggtgtgtcagtgacaaccggtgtgaagttcaagctagctccagttggttttaactcctatcatttggaggatgcagaagatcaagttaccattgaagaactgtttaacacaataccgggaaatgctgccattggtggattccatgaatacggggaggctagaattaatggaatgccgccaaaggggcccttcttatggtcgttacttgcatgctgtttcagtgtgatatatcaacaatcatctttacatagaaggctagaggaattaattagcaatgtgaattttttaaaattcatgacgttatttgacaattattgggtgaaatgtttcacaataacattgctgattttacaactgataatgtgcataatcgcagcgacctggctcacgccaagatgctattatgtcactgcaaatggagcgagagctgaagaattaacagtcagacccagaaccgtgccagttatatctgtaaatagagcaagaacagcgcgatatgtggcaaataataggatagcctttgcgttcgcccttgctaatccacagtacactataactagtgttgcagatatgctgaagactttgcccaatccgaagaaaccacctggtcgctccaaatgtgagacacgtgagtctgacgacgattcagtgactaaggctgctgtggacaatccactgcttagttctcaacgactgaatgtgagtgtgccagacatcacatacgaaacccctgtggttatcagaccacataaaaaggagtcagacacagtcataatgatgccggcgcttttcaatgacgaaatgcaagaatgtatgaggcaagaaatgaagccttacatactgcaattcacagaaaatcgcgaggtggcgcccttctttaagacatcaatgaattatcttagaactgtgatgattcaagcatgcgctgcaggtaaaactgcatgcgtgattgatgacgatccagtgaactatccactagatgggttctatcattatatatgtaataatcgacccagagattggcacgcacaccttacgtctattgatcatttagcacagacaagagccaatggttataaaatttggataaagagcgcgcccttgtaccaattgaataatagatttgattatatgctgatgccattaactcaatatggttacgacataagttacattgtgtttaaatgtctgagatgcagcattgatatcatttatgccattgaatacaactcattagatttgtataaggaagcaagagggccgctaccaggcgtaggattgaaatggcgagcattagggaatggcgacaaacatacaactttcgagtttagtccaatagacgatggtaattcaaaatcttacttaaacagagacaatgttttacgacatatgttaaccaaccaagtgcaaatagattcgtttttctattgcagatcagtaatgctgcaatgtggcgacatgcagttggtgaagtatactaggcgaaacatcccattaaacgacgcaactgtaaaattatcaaacttttactgccgacatttcagtagatgtgtttcaccattcagaggttctacaccattcacgaatgctaaagcaaaagtgatgatagctcccactagcacagtatatgtcatattagctaaattaagagatcaattggtattcaactgctctagcgttgccacaacattatacactttaagatctgtgtatgaaaggaatataatagttgcatgcgccaaaggatggatcgaaagagctgttgactgtaatccactcactcaaactttgatgcatgccgcgcatttttacaaagagctgggtcctgagaacgacggtagcgatatgttgacacatgtggatactacagtttggcgttacttaaagctaatattcagtagaggatacaggcgaaaaacttttgcggccagggcagccaaaaagttttgccatgtattcacaaatgaagaaatgattcctgcgatacaaatctcaatcacatccgacgagttacaagagttatgtgatagaaatgtctacccacacattcactcagataatgaatatttcgattattttccaagcacctttgcgttcgctgatcctgacgaatatcgtcgtatgttcacagacttattcatgccactacgggcattcggcggattgtttggaaactttatcgcatgcttgcaagtattgctcataggcgatgaaattgatacagccagggtagccggcgaatataatgcaccgctattaggtgataacctggatttagaagaagcagcagctatagctgcagagatgcatgaaagcttagaaagagaattcgctatagaaggaaggttcaacacaaatgaattacatgcagctgaggcgctggaaacaatgtctagattgcgtacgagcagaacatcaaacactacatcactagatggaggtgtgacacaaccaacctctggctccatagagccagatcaactaaaaattaaagaaaggttgctcggtcatccaacattccatcacacaatgaatgcgatacatgaactagaagaatataactcggtaacaacccagataggtgagacttacaagacaacaaataatgctctcgttgaatgtgtttttcgctgcccagatttagcacatcaatttgtaataaataattgtggtctaattgatccctgggaatatcatgataaactattatctgaaagccaaactatattgattaaaggaaatctattcataggagcggcagagacgaaagaaatggttacaagatcggtgatcgtagaacacacggatgcaggcttcgttcgtgtcaaacccacagatgcagaagcatttttcagaagattaaaagagtacatctgcatcgatggcaacacaaaagatttattttcattgcacgatgcacaattggaagatgtgcctgccggaggttgctttttcagagctatagggcaagtgataccgcaaaataaccctgtagctcaaatgagtgatgttataagagagtgcaccaccagcaatgtggcaatactatataaaggtaacatctataaatcaacaactgcaggcaataatccgacaaaaatgatctatgttcaacagaaccattgcatgaaattaagttccagccgggtaaaatatctgcttagagaatatcctaccaaaagcttgaatgagttcactctaagcttgaacggtccaattattcatgacacaattgaagagaggctgagagatttaaagaaatacgagacaaaaattaacgagctaaaaagtggagatccaaggctaaaagcgatacaagaagtgctgctatacaacatcactctagaacgcacactgatcagaaagtttaatctcatttcagatactaatgccttgtcatatctcagagccacaacagaaatgtcggtatatgacacaagatgtaacaagtggataaatggaaacctaacggagcaccatgaatattgctggtcaaatggcaagttccaacaattaaaatacaataaaaaggagaacatattctcatgcgagtcccaaggcactttcatatttacaaataaagacatcgtgtttttgagagagagaatgttactcgacagagtgatgccgctatggcacagcctgattacttatccctttaaagacttgataataactctagttaacggagtagcaggctgcggtaaaactacaaccatagacatagagcacactgtgaaccttgatatggtggctacaggaaccagagcatgcaaagaagattatatgaagcctggccgtaataaaaattattacagaacatatgactccatcatattaaatggagcaccacagtgtgatacaatgtatgcagatgaaggacttatgattcatgcaggcgaactacttatagctgcatacatgtgccacgcaacaaaaataaaaatatttggagatgagcaacaaattcccttcatcaatagagctttaaattttgcaatgcataataacttagtaatcccagatgaaatccgtagacaaaacattacatacagaaatcctaagtgcatgcttgcaattttaaagcagttctatgaagatgtggaaattggctctaacgttgaaggagaattgcgaaagattaaaatcaatagcgcaacacaagtgttagacgactacgatgcctatttagtatttacacaggctgaaaagaaaatgttaaatcatttacctaaagagaagatatttagcgtgcacgaagctgaaggaaaaagcttcaaagatgtcgctctcgtcagacttatgccacaaccaaatgcgattttctcaagtgaaccgcacgtgcttgttggcataactcgccaccgcaataaattacattattgcagtgttctagagaatgatttcacatggcagactttgagtatagagaaggagactcctgaggaaacacaggaaagactcataaaatgctttgatccaatacaagcactgcctgttacacctccaaagaggatgcatgcaacaattaatagaatatgcaaaatcgacccagaatacaacgactgggtggaatggctattcagtcaaacagaacacatcacaatggaagacattacctaccaatgggaactattctcaacggaatggccagaaacgataacaccttgtaaatgcccagaattatccgacattcaagcactatattatctcatgtatgctccgaatcccaaattggaacaagagcgattaaaactaggcatgaaattccctttaccaaatcaagtaaaggtaaatccactgagattattaaaatcaatgtttaaaaaagcaacagaatatttgataccgaaactcggaaccaaccagccaataagagatccaggggatatatgggccgcaatgaatgcattattaaaacggaatttagatcccccagtagtgcactttgcaagaccacctgaaataataaaattgattgtggatgtattctttgacacttacattgatgcaaatagattgaacactacaaagatgtttgttcctttcggcacaaaagcacacacatattcatggttcaactcaagaataggatcaaggaagaaatccctaataagctatggaaaaagaatgccatctgaaatacattatgcaacccacactagacctgatatgaaaccgacattgacgggagcgcatgaatttgaagcagcaagcggccaaacagtgacagcacatcatccaaccataaccgctaaatatgcaggaatgggacaatatgtttcagatttattaaaggcatcattaaaagatcaatggttcataaatgatggaatgaaccaacaacaattaaatggagccactaacttcattctcgaaggcgttaaagagttcattcctcaagaagttgattttgggaaatttgacaaatcccaagaagaaatatgtttagctgtgcaattagaggtcatgagaagattaggagtatctgagcacacattagaagaatgggaaaaagcacatcaaattacagtgctaacatatcacacacttggtataagcttaaaaacaaaataccaacgaagaagtggcgatgttatgacctttataggcaacacaatcgtgctaatggctacgttagcatttacacatgattacaaagcagcctatggaggaatattcggaggagatgacagttgggtggctttacatccagataatgcgttgacagattcatcgagcaatattgctcaaattttcaacttaactgcaaaattagaaaattttaaagatgcgcagtatttcgctggaagatttttaatacatgcggaatcaaactactactgggtgccagaccctgtaaaaattgttactaggttaggaaggcacgattactactgtaaagagcacttagagtacgcctggatatcattttcagacaattatagaatgtatcaaaacttagaaatcaggctaaaagcctgtttagctgcagctgcaagataccagagaatctcaaaacaagaaatttatgacttgagtttatttggagattttattgctgcgcttaccctaaacaaaaagaactttttaaatttatttaagagttcttggaggatatggaatagaaaactacccaaagcgcttaaagaacaaattgggcgacaacagtcacgccaaagaggacttgtggatatcacagaaagcacagacccctttgaagaagactttttaatatttatgtaaaaaaaaaaaaaaaaaaaaaaa

SEQ ID NO: 542 - DNA, 7104 bp, Unknown
  derived from dsRNAs of unknown virus
  misc_feature (1)..(1): n is a, c, g, t or u
nggaaaaaaacatatgaggttatgttttttttcaggcccgtattaatgctcccgtattacccgtcgcttttgcggcccaaagtggttctcttcggagtgtttgctggttacaatcgttgcccctcgcgcaagtgggtgttggcacttttaatgcatacgtatggactttcacgagtccgtgccctttttatgcagttaattaaatcccaaaacccagctccaaaccccgttttcgggtgtgttttagttttttggtggtttagttttactgagtctgcgattttaggattgcagctttgttgttcactttatttcgggattagctccgaacggtcaatttacataccttgccgtattgagtgaaattgttattaagtatgatcattgcttaatccaaatcccacgatgtgggtaagatcttttgttttaacaataatcttgtgttgaatatgtgtgactaatatgtctctcttacgtttatatgggtagacgtccgcggatgattgaggtcaaacagaacttgatataagtatgtgttgtgaagaatatcagataaccagctgtgaattggttcgaagtttgagaatatcagacatcgcttgctgctccaaccaggagtagaacacagagacaaagttaatgaaaatttgttacatattatgttagtaggaaatgatcggatgtgttagttatactgttatcgtgcagaaataagacactctatttcttttgtgcttgcaccgttgcatcgtacttcgtagctcttcttcagggtaaaacgcccgggagagttcgtctttgactatgaagattggccttctgtgggggtcattaaaatgctcgaaagtctcttatcacatgtgggactatgttctttttggagttacgatctaccttgcccgcgccgtgaattcggcaacaggctagactaggctttcgtttttactttcgatttcgtattgtttgtaagagcttaggctcgctagttgtattaaggagattcgtatatattgcgtttctgcattgaaaggaagaaaaacctagattgcagtaagattcaggagtcagactcaaggatcaaaagacgcaggttcgtttgtgtgaatggcctcggtacctcccctcgcttgaaaccagatgaagatctgaatattctcgaaaacatgagaaaaacaaattatacgaccgaaaacattgttgtattcaacatgattgtcataattgacatcaatggtaagtacctcgttggcaagttgcccgcaggttgcgtaatttagcctaacttcatccttcgctcacgcaggagggtaagagcagctgagttatagtgtgaccatcttatattcaatgagtaaaaacaatcaacaaaaaaagattaaagtaacagttgattccgaggtagcccttccgtgctgggcgaaagaagcacataagtctggagtgaccacaggttctgttggaactgtggatgctcgagtctcttttatgatggagagtgtaactgccggggcagtaggaccatcattaaagaagagccgcatgctgagatcagcaatacaagataccgttaaggtttttgatgcggcagagtcgtggaacgccagatattcgatgtctagggcaaaacaaccgggtgttgagatgagagacgctttgaaaaacacgacagaattcatccccacgaggtttgctaattcgtgcagcagaccccccgttgatctgaaggtgaggatgacagccatcggttgcccactggctaattgtaaaatatcacctaagaaggaggtggtaggtgcaatagttaaagagcagatggagtcgtgttcggctaagccgttttacgacatgctgcgtcacgatcccaccaacacgatagggtggatgatgacaatgctgacgcagatggacagcatgtatttctctaatttacaagaagcgaattcagttctttcatttaggcaaatacggcgtaatgtgttctcagactggtcgaccatcggcgcaaacagatggactgacgagaggataaacagcgcgccagatagaaccgacgcggaaaagaaagctgaggacaaagctcacaaggcagaattcggaatgacgaaaccttgcgaagggaattggttcgcagacatacttctcgacaaaaaggtggtcaacaggagggttaaatcagctttgcccacggcaaaactcgatttggttccggcgctcaaagcatctctttccgccatgttgcgattcaagcggggtacgaagttcgtgatgaagaatcagccaggtcaaaacatgctccacgtggtggtgggaccttgcggcgttatcgaaagttcgttcgcgttgccgattctaaacaacgaagtgatagctgaagacgtcaaacaattcgtcgaagcaagaatatcgcttgcgaagaaacacaggggcgacccataccctgcttaccggaaagtaatgcaggacaaactctactcaatgaagttagatctcactgaagcagagaaggcggcaatgtcaacatttaaaccaacattggacgaccaagcactcgtagaattagggaagcagtggagagaagccacacaggggtgcaaaccgcaggagaaagctgcaacgattgacgaatgggtcatgttattttgcggagtttaccccacacagatgaaggcgttgatggacgatgtgggcgaagaggcacggttgatgataggtacagttccatcatcagcagtatacccggtgaacatagacgagatgtacacaccggaagagatgaaagcaggctttggggggagcgaccttaagcatgcgacatttgaggcatcagaattcttcgacgagacattggccaaaaagaacagatggaacaaagtctgtgagcacacagcctcttttctgcaaggaaggtccaggaagatccgaattgtaccttgggatagcgtaccaaaatttcatacgcacgaaggtatatccttacacgacgacaatgtctttgtaagtgacgctcgaacgccgaaagagttggttgcagatataagggcgtgctacacaatgaagggtaaatacctttcagttgaagggaaaagtagcgaaactctcgtcgacgaagtcgttctgatatgcggcagactgtcatcgaaacagtgctccgacgtcttaaccagagcagggatagttcgatcgccgactttctcgaagatagacttgtgccgtatctcctggccaattccggatctgatgcggatgacagaacacttgggcgacgtactccattctaacgtcgtcgtcggcgtcaacgaccagagagcaatattcagaacaatggtattactcagtcgcaccactgttccaatgttcgatccgtcgataggcttgactaacaccatcagcaggatacactcgccttgggctgtcagattaggtaggtgtttggatttcatcattccagagtgcggcgacttgaagagattgccggacgacaacagaatatcagagaacgttgaattgctgtacccacgcattgcaatggaggcaaatctaataatcaacaagacgctaggtgatacgcagaactgcgaaatactggaatcactgggtatgaaggccgaagccaatgaacttaaaaaaactttgtgctccgccctatctgttgctttcgctagaggaacgtcttggtgctcaatgccgtcattcagcgtgacttggtatctagataggaaagaagatgccgcggcgaagagaaaaaggctcagagacgaagaggcatatcacgctatgtcgacagacttcagaattcgccgtcttgttcaaatacctctggaatcgatatcaggcttgcacacacagggcccgtctatctgggctttcatgcagttagagtctggaggagtactttcggatccagaacccgtaagcgagaaaataccgaaagccaacggtaaccctctgcttacaaaagatatcaaagacgtttctatgctgctgtttgaagcagatagacagaacgcacagatcggctttcgagtcaaaggaaacaattgcaagtggcatgtcataagcagacgcgatttaccttcgaacgcaatgtgggccgatgtgaatacgagtagaggacggctcggaacaacgaaaaagggttcagaaaccagagattatctgttacccgctcctcagattttgataaacacgctttacgaagagctgatatccacccgttctctgacatttgccagacagcctattccttacctaggcaggtccatggtaaattctgagtacgaagacctcgcagaagatgtcgaccctgagggttgcatcttctgagggtgtggttgcaacattgttggggtgggaaattgcaaaaagaatggtgggaagtctaaaccttttaaggaggacggtcccgaatattctgacggcagtggaccaccccgacacactgcgggagtgacagttaacacttccagacgtagtataaaatgcgtcgatacgaagaaaagacagaaagagatggacgtcgcgagattttgcgcagtaggaaaatgctgcgctttgaacaaaatgaagctggactcaaatgatcctttacaggtgattaagagttgggcagtggaggacggggatcatatggccaagtacctacggctatttgagaaagagaaatgcatctgtgttgaatcaggtgtagagaagagggtcaagatgaaagatatcagtatgagcgagttggatttgacgttgtggcgattcgacaagaagatatactcccaaaggaacaaaccaacagaacagttcagagcagtgttcggtaacaagtgggctttgatttttacgaagatgagcgcgctttggccagcagaggttgtggcatcgctggtgagcgttttggggcctttaacagattgctgtgaaacttgtttcatcagcagattgaagaaggtttcagctaatgctgtgagatggaatattttgaagggacatggaacgtggagttactacgcagatctgaaggtgttgggggggtatgattgtgaacctaacagagcagatgtgtacacagaagcgatagaacagatatcagatacggacgggaagaagattactttcagtaagcaaatggagttggaggtgaaaaacataatcaggggattttcttggaagaaacattctgaacaagtcagcttttcagaatacatggaattccgtgatgcatgggggtcacaaggagcttgtagcgaaggcaaacctttgaaattcgtagtgaataaaaaggcgaagaagggtcgaaagaagaaagaagaaacacagagcaaaaagtttagggtgtcaaacaagttcacaaattgtttaggcatgtcggtagaagaattggttaaaacagcagtcgagttaaaaccatgcgatatctacccctttactaaagctgacgaacctgctagaacacgcgcagtgttcggcgttgactctagatcttatcggagacaatcatacgtagagaaatgctttatgcgaagtttcaacgggaataaaccctggacaacattaggtctaggtcccgaacaaagaaggagattgagagcacgcctagctatattaaatgcaagtgataccgtatttgcagttagcctggaccaaagcgaatttgacttgacgcaactactatcgtcagttacgtttgcgatgcaagagattttcaacgagtgtagaaaacacgtcaggcccgatttgttagaagaattcgacatgatagagaaggcagaaatgcattgttggaaagaagccagagcgcacttcagggagagtgggaagatagtagattggaagcggggcatgccgagtggtatgttttggacagcattgatagacaccttactcaatgcggccgaagcacgcgctgtcgcaaaagatctaggggtaacgttgatagacgattgttttcaaggagacgacgcagtgttattcacaaatgtacctacaacaggtgaagattgggcgagaggatacggagcttacggatattcagtacatccagagaaaacatgggtgagcaatatgagatacgaattcttgcacgagaatcacggtccggaaggtgcgtggggattcccttctaggatgggaaaaactttgctgtggcgaagaccaaaactatctggcagctgggctccaaaacacgcaagggatgccgaattctctgatgcattgttgagcggacacagaagaggtttagtaaattgcgttgaaacagcaaaaagattactgggagaaagagtgggtgggaaaaagactaataagaaagaacgtatgctatggaatgctgtgttcacgcccagagccgtgggcgggttaggtttcggttctaagggaagaaccagagtcaatgtgacagttaagggaaaacgtagtgtgatagataggatgaggatagtcacgcaagttgacggaagaagtccggattggatatcggcgataaaacgacgtttagtggacacagtgccttgcaaaggtatagttgctactacaactttggagacaatcaagacagaatctaagacgatgcgttgcccgaaaggatttgcgaaaaagtcacatgcattaaggttgcaatggacattatcagatgtaaacatacgcaaagatgcatggaaaaagaaattgacgctagaagctaaattaggaaacagattattacctaagatcgtaggagacgatgttttagatgaaaggataagaaattcaccgttgggtgtggatagagccgctagactagcagagagtatatctagtttagcagcagatttgagttcagaggctacgacggccgaagccttcagcagttgggcagaaaggattgcaaaaggatggtcactctatgttgcgagagtgataggagggatcgaaaagctgatgcatcgaaagtgcattagcagaggaattatagagttcgctcttagttctatcgcgtcagcagcgtcgaagggtcgcgttgcggtgtgaaagcagtgttgcaagggtggaaaagggtaccaatgttgaacgttaattggtgaacggggggatttgctagatcttccatataaaaaaacaaaagaatatgagtaaggg

SEQ ID NO: 543 - DNA, 5311 bp, Unknown
  derived from dsRNAs of unknown virus
ggggggttacatgtctagtctaataactagctcacgaacggcacctacttgccgttgttttgttgagtgacgggtttgccattctgtaggttgattgggagggcccgtggagggccctcaccagggttgtagcgcgtgttgctgaccgacgcattgtagcgttgggtcttttacgacacggtcgtggttgaagatgttgttacgtaataatcggagtccctcgggcgcttgcataggccatttcctctcctaaacagcgtggcacgctggtgtggcgaaagctgctgacacaggaaccacaatttgtggaccgagtgtgccctttagggggtcaagagactgaaagtgaggtaggatgcacaccaacatcccggggaaacagtccagccgcgcatcccaacggccttagccaggctgaaacgcggagctccaatgggagcattgaagaacgcctggaatgggcgcaaggctgttgagacggttatgcaagaggccgtcgaactcgcgagccaggcttcgaacagcatcatcatgtggtccgagaggatctgtgaatggggtgtctgcttcgggcaaagcgcgagcatgcaatctacaaacgaggagtcgaactcaaaaccagagcgcatgtgtgtccaacgggagattgtatagaaatcgcagcatcagtagaagatttgcattgtgtaaggcctagtgaagtcgaggaacatttcgtgtcgtttatacatgtgagcattcttggcaccatattagcatgcatcttagcctggattaaatgtcgcatgacttggataaccataaggaaaattagacgtcttattcgccgcatcgtacctgtcaagcggaatcagtgggcgcaaaatgccgctctcgtgcgcaagggccgacctacaaagacgctgttgcagttcttcgccgacgggacattcaaaactgtcaggaagaaagaccagccacaatggtatcacgagctcgatgccgaatgccgttgtccggcctcatgccgtcaacagggagaagaggtctcgctggaggggttccatgtcgccccagtctgtctgcgagacttcaaggccggatcttctagccgacttgcttcgacacttggagatctggtgctgaatgccgggtcagcctacgttgttaactggaagctcagccctgaacaagtcgacgagctttgccagacatgccggtcgtctaacggcctacacttctttgaaatgtcggaacgttcagctgagcggattggcaagggtgtgcaggagggtacacgtcagctgctgtacaaagaactgcgagtctcactggacggactggaaggagctcggctgcccgggactgggtatcagctggctccgccatgggacttcgacgaaggcggtggcacgggggtccttcgccctgacaggaaactcctatcgttgagcatgcctggtgatgccaatgccgcggttgtgcaactcgacacgcatggtaatcttgagctacaattccacagcgagcacctgcgattaacacctgaagacatcggctttatttacggggtttatccgctggctgttgagaccgccaaacgcctccgatcgtcggcatcaatccttcaaggtgacgccggtcgtgctcaaatgagagacgcagcgataaatccgtcccagtatcatcagaaagtctccaagtacgatgtcgaatggatgcccacagaggcatggagtgagccacccggctcaattgaccagatcgtagccgactcgttctcagtgatttgtctaccggtcgctgtggcgccattacccatgcccgaatgtcgagagcttaccgacttggcgcaggcggtcatgcccgcgtgggctcattggtgcactcataatgcagagcagaacaatcctgacagcgcgttgcctggcatcgctgagcgggcgatgctgatgttctcgcaagcagccgacgggatgccgagtagcactctgacccacatgcacaggccattcgagccgcactttgggggccgctgcgtgagacacggccaaagcaatctccactttatgacgtcgtgtttgacggatctaatccttgaaggtgggtcgccttcactcgagttctgcaattatatggtgccgtacatcacattgacggtcgacacatgtgccggctttgagccaggctctaaggtattctcgacggccactgacgacaaatatgaggcggggtgcgaaggggtgctgccagatggcttcgaccattacctcatctacgtgccactgtcttgtacacaccttccttacgaggacgaggcgaacgttcacgttattagggtgcaaccgtaccgtagcaatcgtagtctggcgatgtttcgcatgctccctcactatttcgtgcagcctggtttacagattttgtacagtaaccgagatccaatgaacatgccatccggatatcaagttttgatggatgaagtgactgacccggtgttttgcgtggctcaattcaattacatgcccgtgaatatgtcgtgtctcatcgcgcagaccggagtagctacgggggcgagaggctttctttacgcttttgaagtggcgggttttgtctacggcactgacgaggcctgtttacaggctgctcgacgagtcactacgctgtatggaacagaccaacgattcaagttgaccatgtttgacatggcagatttcttagcttttgctccgctgaagttcactgccattgtgaggaaagaatacaacgtcacgaggcggcacacatatgcgtgctacaatcgccacgttgcatcacaaatcatcaaaatggagcacttgctgcttgtgccttcgctttcaaagagggtgcgactgggggaagcattgagatattgcgctgccaacactggcacgttcacggaactttcgttaccagattacaagcattgggctccgatgctgtcttcgggcaaggaggccccgcgcctacagtcgactgtcggtcctattgtattcttcacatttggaaccaggggagacgtagtgccggtcagagccttagccagagtcctatcgaaggaagggttcgaagttgtgcttgtgaatttagtgcctgcggaggatgcggcgcgcctgctggcttcggtggagtcacagcagacccgtgagtggatcggggctactatggaagcactacgtgtcgccacctcttgcccgtatgtgaagttcgttccaaacaacctgcgacatgctggtggtatcacttacagctttgcaccgcctgccttcgttgcgaagcccatgcgcctcggactaggacagtttatgaacttcttcggtgctctcgtgttgtcgccagactatgctcattttcacataggggcttacgctcttaagggctggctaccacgaagcgctgatggaaagaaattcctaactagacagggcaatattggtaagcacgaggctgccgtcgtcctaggctcctcctcagtggcaccaccggctaccttacgagggctgccggtgattgcctctgggagtcacgaatatgctttcaagatgtacaagcacatatggacaccgggaggggccggcacagttcagacagccgcatgctcgggatgtatcgtgcacgtctggtctaatgcagtggatcgcgattatcggaggcctaacaacgcagggcatgaggtgagcccagggcaggatccaaggctgatacttctcatgctagcccatcacgatctcacgatcgctttggcgtatgccaagcgaagtcctgttgccgcttggcgcgccttgacgtgggtggtgattccaaggacctacaagtttgccgccaatctgttgtcactgctcgcggcgtccacgaagaggttgcccaggctttcgctcgtacatggttttctaggttcctttgcagaggtgatgttgccaagcaccggatccgacatcggagattacttgctgataagtttaatcttggccatcatggcggccgtggaggcacagacgggcgtaaagtggtatcggttgttcaagcctgttttgcacattgctctggaaaatctttcggattcagggtttgtgccggcaatgttgattttcggaccgactatcgctttgttgttcagtaaaaccatcatctccttgggctggcgcctctttgtcgaattcatcgtgtttgcgacccgctgcgttagtgggaactcactactcctgcaaggtgagcgccctgcaggcttcgacgtggccctcgaagtcgagattttctgggactacgtggtaccaatggctcacaccaagctcgtgtgccttagtgaaaagaagtgctatgaagggtcccatctttcaaaggaaaccagacttggcggtcttttcacaacacgttttgttccctgggaaggagtcaatccatccgccttttatgtgtcaacgaagttgtccccggaggacttcaatcgtttaccgataatgagcggcaggtatggagccgtgtggaactgccagatcgtcttgtaccacgcagtgcacaatccactcgaagacttcgggttcgcaggcgcaatggtcttgggtattggtatgctttactcttcggttctcactctgctcgccatagccatctatcttgcgctgttgattgcttgcacattgccctttggcttcagtcacgacagccgtatatacgagtttgcaaccaatttgggtggcggcctggatatgtataccttcgagatgtacctgccacttggagtgcacatgcgcgcctatcgattgtgggcgaattcgatcgtcacagggtttggcaacattgccgcccgccttcgagacgctgtcggtgctggttcggaggaggatgacgtcgtccccgagacggctaccgaagctacagcagccgatgaaaacgacacgcagagggtggctgacggaagcattatgctttcgcttggagaaacgcggacggatttggctaacgcagaccgacacactatgagggcggctaacgtcacgtcaccggtggcttcagtcgccgaaagcctacattttgaacgcgagcgcgcacagcatctgctagccggactacccgcaccttacttggccatgatgaggaccatggcggacgttgaggagcgcaggaggttagacgtcgccgaattggtgcgcatcacctctttgacgcttgaagataacggtgtagtagaactccagcagttcaagagtttggtgttgcgtacatacaccagttcgagtgtaacggccacgcgtaatctgcagacactcggcgcggccattgaccggatcagcttacaaggtcatccagtgcaggc

SEQ ID NO: 544 - DNA, 5272 bp, Unknown
  derived from dsRNAs of unknown virus
aatcttgtcggccacccgggcgtgcccactctgggcgttgctgccatcaacgcagcaattcctggcgctgcggccggtcttcctgaggggtttgttcgcatgtgccagtcggcggcgagcttcaatgcactgactagtcagatgctcacttctgagctgcaagcggtcggtcccatcgtgcaaggcttcaattttgctgcgtaccttactgttgctgtgcctcctgctgctgcacctcctgtggtgcccgctgctggcgctgctttcgccgggtttgactatgctagcgcatactcactcatggcttgcggcgtgcaaggctctggctcgcaggcgctggacagcggtctcaccgggctttttgctcatctgggcaacaagaccagcgtgtacgatcgtcagaaggcaaccatcccgcgaggcagccctgagacaatgatgatgggcatctatatgccatcactgctcgttcgctgctggacggactattacgtgagcaccctgcagcagtgccagagcaccgtctctcaggcgacagggttcgtggacctcaacccgccgaaccttgatgtgaccgatcactatggcatcgctgtacccgacatcacatttctgcgtggtgcggatgctctgcagcatgtgtcgctctgcgttaagcagcgtttccactatggtggcgcgctcttcaacagcgtcggcgccaactgcaacacggaagaatgctcgcgcctgaacacttgggtgatgcctgttgcttttgagcccaacagccgtcgcgtgatctgtggccgcgattgggacatgcccggtgtcatggccctcagcccgcagtttctgtcggcggcgcgatcgggcgacaccgtgctgtggcgcgcaaaagggctcgaaaatatgcgctatcgtgacattgttggcatcatggtcgagctcgctcggtatggccaggcgcgcatcagcctggcgttccgcatcatggtggctgccagtgccatcaacgatgagcccgtcattgctctgcaggccgtacctgatgtggtgtgcggagcccgcgcttctgaccaagcgccgtacctgcccacaaaggtgcttcccggttcgttgttctgctctctcatccacgttgggcagttgcagcttgttggctggcagcgcactatgccaacactgtttggcggagtggggttgctcggtcgcctcactggcggtccagacaacgccaacgccttcccaacgtatggtgcagctgccgctgccctgccggtttcgacgagctttaaggctatcaacgatacgcgtgtgttcattgatcgcgtgcagcccgtgcccgtggctgctcctgctattcttggtgcgcccacgaatcgtgaagtgctcgactggcagactacgtttctcaatgagacgttgcagtcccggcccggcgcctggtcaagcgagtgtgcgccattcttgacgccgtttgcttccaagcccgtctggagcaagctttgcggcgttgacgaagttgaggctaagacagcggtggagaagatgctcaactctgaggacttgggcgccccaccgttctaggatagtgtggtcgacacggggtcagatcctcttggtcggctgtatgtttccgtaatctgcagcttccatctgaagcgtggcaagcgggagtcggtcggcgactgggtccacacccctcgtaggtttcatgtcacaagagtgatgtatgaacatctggttgagtgtgtgaagtgtgatgttatatcgatagctgtgtttagtgattggcttgaattgtgttttgagggtgtgaggcctgattgggtgtattctgggttaatggctgtgcgcagcccgcgcgtctgggctaacttgcgtgcgatgatggctgaacgcccggctaaactgcctaacgagtgctttggtaaggtgtgttacgatgctgctcctgagcatcgctctagtgtagtaggacgggatgacaagctggggagtgttggttctggtggtgtgctgttgtgggcgccacctggctcggggaagacgcatttctgcctcactgccaaacctgtttcaggtttagctgtgcttgatggagatgaaatcatgaaagacgcgggtctgtggcgcgttaaggacaggctcatgcgtgagtctcacgactcgaaacggctcaatcagttgctgcgccagcaagtttatgagcccggtgtgaagttgatgattgctatggcggtgcgcaagcgctcagtcgtgatgacggcggttgtgccagattatgcaatcgatgcggctgatgcagctggtgttcgtgtagtggcatgctgcccgagcgaacagacagttcgatccaactttgcgggcggcgcgcacgttcgcgtgccagggcaaccgggtctggaggaatctttggcgaagaatgcgaaaacgctgggctcgatgcatcactttggtctgcatgttcatggcaccattagtgatgcattggcatcactacctgatgagcagtcatatcgtgaggaatggcgccaagcatgcctgacgtggctggagaagtttgtgtcgggcaggtccgagtggagcgacaccttctatcgtcggctgcggcacatgttccctagtagctctgaagcacttaggcaacgtgagaagttcagcatcagtttggtgttgaaaatgtggcgtgtttgctccgtgccatcggatatggcacgtgatttgcgcttgattgctgagaaaagtctgggcatgggtggtcagtttcttgtcaatgccgcgctttgcttattgctcaatgttagctgcagacgcatgctagtgggcatggcggggcttggggttatgcagtctggtcttgcctggtacatcaaagtggctaaggaggtgcacagcgttactcgaagtgcagggtcatgctggtgtccgatgctcggtcttactggtgatgaggactatgtacaggtgatgtatgttgacatactggccggtcgattcagcttccctgcgctgtcatctaccgatgagatcatcactcgtagcgttcatggtcgtcctcaacgagcctacacacgtgggggtggctggagcgaagctgagttcgagagacaggttggcgtgagcatggatcgaattcttgcaggtgtttgggcagcaaagcagcgcggcgataagcacaacgtgtctgcgtcaatagcacacttcacgtcactaggcacgtccggtgctgcgtcggaggcacgacgtgtgaatgtcgaggttgctggcacccgcgagcagctgatgagcccaacaaagaatctgtggctgggaatgctcaacgagcgtacggtctctcagtttctcaaggacaacgagccccaaattaagggacgtggcatcgacaagttcgaatcgtccaagctgcgtctgctcttgccgggcccattgcgccattggttcattgagagtattgcgctgtggggtgtcgagtcacacgtgtttaagaataaccctgacatcgctttggaggaatctgctgtggaggagcttttggcatacacaacacgcttgatgaacttaggcggtcgagtcggtacaaaagggtgctcagacttcaaggacttcaacatcctgcataccttccctcgcatgaagcggcaatggttgaagctggccgaagcagtgtggcccgggggtgatgtcaacgtctttcgtgctgaatggggtgacatgactctggcggagtttagcgctatggcagcacgttggtgttgtgcggccctggattctgtagaagctcgtggtggcaaggtgggtgacaactgggtggagttggtacgcggtttgtggacagggtggcgctcaacgacgttcatcaacaccactcacaacaaacactacgattatgtgatcaccagcacagcacgtgagatctacggtactgctggtatggtacgcacatcacgtgttggtgatgacactgagggtgactttgtgagtgagtatgactgcttatgctacatgtcagtcatagatcagatgggcttggatgcgcaagcggtcaagcagctggtatcaaccgagcgccgtgagttcttgcgtttgatgtatgccaacggggagatcaaaggctccctcaaccgtgcgatcggcaacgctacgagcagtgatctgcagggtgaggcattccagggtgggcctcaggctgtgcaggctgccggctccattatgaacacctggttgtcacgcggcggcgatccattggccatcgacaacttctggtttccagtgctcacctacatgggcagtgtgatcatctacgttgacggctctgccaggcgggtcgcaccctcacacggccttatatcggcttgtagcatgaagggtggcttaggggtagtgcagcgtgggtgcgttgagcaaatgccaacaagcgctattaccaagatgcgagcacccaccagacggcagctcattcagcccatcgctcgccagctcaggggcgaggtccaggacatcatggtggcatcggctgcggctcaattccacagtcgtggatacaagttgagtggtgctgatgaggtgaaggatgatgttatgagtgcaatgttgggtgccagtctgccacctagcgcgctaaaggctgtgcagcgcagtgagcgcaactgtgttgctgagtggtacaaaaacaataggggcgtgcagactgtggcggtcgacgtccccagtaggattgagaagatagttggtcagacattagacatttgggcgataagctgcgctaggcagggtatgccgccaagaggtgttgcaatcgagggcagcataaattcggctttggcgttggcaaaaggaacgctggcttgcgtggatagtgtgctggatagggttaagtcagtgggtagtggcgctgtgagtatgtggcgaaaggttcgcgaccttggtggacccacggtcgttgagttgacgaatggtgttgcttctgttatcggtcaatcgatgacggaagcaattttgggtggaactatgcttctcactattccctcgggcggaagtgtcggcagtgcgcatcgcgcattgcttgacgcttgcttctcggcggttgcagaggatcagaacttcaaccaaacactgttccccggagatgctgatcatctccaaaacagtgctgctgctgttgcaagcgcagtacgaacacagctgctggcccacgagtattgggggccacagcagcaatattaggcgtcatacgacgcttgttgctcatctcgtttcgacgagatgagcctcgagcgcgcatgaacgc

SEQ ID NO: 545 - DNA, 4227 bp, Unknown
  derived from dsRNAs of unknown virus
gaatactttaaactacataatgcagaacataattgagttacaaaatgaaagagagagagggattagagatagattgcatacaataaaagatctgattgaagagacgcaacagcgcgtgcgcccaggacaggggcaggcgatggttgatgtcggtaactcacaattcgatatgatggtcagagtaagcaaatatttcattaatgttttgaacgattatcccgaggatggcgagcgagctatgctcatgattgaagaatggtcgaagcaagatagacacgctgacaacccgaacgtaactaaaaatgatttctttccttgtgtgattcgatcactcaaggaaaccgagtttaatgtatctcaaccaccggctgtgctgacacagcatggtatggataagatgttacgagctggattagatggaacgaacggcgtatctaaggatgatttctcaacgtcatttattcacaatgtcaggaaaggtaacgtaacaatactagagaaaggctcttcctgtgtgattaatggtgtggagctgaaactgactccatcggaggcacgttcaactgacactaaaccaccaattgatagtgatgtatcgtacactgaatcctgggttaatagatggggtgaggcacgtagattcacaccattcacaatgtgttccagctatgcaacgtggattgagctgtatcagcaaatggacttggagtggccagaagcgaaagcaagaggtggattcagtctacttgttggatgtctatatctagcctgtgagtgggcctgtaggaatggaactgctttaaaaggtggcgccaaatccgcagatggttttagtaaaaacatcttacaatcatgggtggatggatcatcagttaaaattccacaatggatgaacgtatggcgtatgccaatggattacactacaacaactcttgttgatgttggatatgaagctctaaaaactagaggcttaatggaatggtcgcgaggtgagctttctaagtcaattggcggagttgtgccagctgaaacgcgtatgccgttcgttgagagatcagaaggtgggttcccacttcaagattctgctttaacaacaatgggcccgttacgcatgtttttgtgcttctcagtcgcgttagaagttactggatcatcacatcttgatgatcccagcgtaaatttccatggtttcagtaactacttggaaggcgcgcttctatttcttggaaagcatccagggcaagttgggaggcaaatggacaaggtagtggtgcaaatgatgcgccttttgagcgctgacctatcaatgaatgtcccttcggggataattgtaaagcaagagtttgatgatatgccttttgacacagaagtgcagaggaatatgagaatttatgatcaatactcgatagcgatacttgcacataatcataatgtacctcctaataaacaatcagtggctgaggcaataagtgcagttatcccagagttaaccacaggcctgatggaaatcttcacagagtatagcgggaacagcaacgccgccgataaatacaatgtctcaatgtataataccaagatgctggacgctataacgcacttgactcaccctggtaacattgaaggatatagtagatcgtgccatggttcgttgcctgtcaagggttataaatcaaagacgcaaagaatagtactggaagacataaattccagcgcaccgagattggttgataagtatgaggaggagctattctcaaatatatttgaaggttttataccaccagattcaaaaggaatgtttgataatatgtgggctttatcaaactcgcgttccggtggtgcagatagagttggctttaaggtttcaccccaagtaattctagattcagatctagctgggcagttcgatgaaggttttgtgtctaatcgaaaagatgtgatgcacttcactgcagcattcatcatgaatgaaacatcaatgatgacgagagctacaccagagagcccattccctttgggactacgatctgtggcagcgcgcgtactgcgttacatttataacttgccaatcacgcaacagattataatgcgtcctatttataagcacataaaagatttcatggctcattcagaagaaggatacgctattgagcaaaagattggtgtagccgtggcggacatgtcaaatgaaattaatacgtcgatatcattgatacatgatccctccacggtgtgcctagcccacgacgctagcgcactagatcagcatattgggtcgcgtcatcgagaaatatggcgtaaggtaatgtcagacgtactatcagattttgagagtgattcgttgtcgcaaatattgaactctgatgtaaagtatcgcgagctagttgataatgtgctatcttcctgggacgatgcatattttgaattcgctgttcctcaagcgccatcacagtttctacatgcggatacacaaccatcaggagcgataacaactggttcagataacactattaccactatggcaatgctgaacatgattgaagccgaaactggagataaaccactagcaaagcaagtgtggggtgatgattgctactttgcaatgcaactacgatcggatgatgacataattacaaaaattaagcagcatgaagacttagccacaggtgcaggtcaggtgttaggtactattaaagattcaacaagtgggcgtgtcgtacactttcttcaaaaactattcataggtggacaggttgtctctcgtagaatggcatatgatcacgaaaacgcacaaaaccacgaacgtctcccaggtctgattggtgaatacctcgataaaagtcgcgatctcgcaatgcgtggtggaaatctcgtcttactaaatatgcttcagttgatgaccgtgataaatggttcacgctcaactgtttttggaagacaggccgttacatcctttgaaagcattgccgcgccaggtggaacaactaacagattgctatttggctacggtcaaccaaattcaaaactctaccttgaactaaacttcccaagaatgtatggtgatacaacaggaatgtacgtagattctaaagccgtactagatacgcctaaagaaatcggtaagcgggtaattgataaactgtcagaagaaaaggcatcagtacgaatgcaattgggtggtatggagataaagcgtccagatggtcaggattacacaatggatgagctacaacacactgcatctgaacgattactaaagagtgataggcgcaggcggatggggcttaatgaaaagactcgcatcgcattaacagacgccgatgtcatggatcatgactacgagagagcggtaatccgtggtggctacgatgccattggcggtatgctacgagacaagagactaaattctaaatttaaagagaaagccttggttgctaacggattcatatcaagacattccgataagcaattcacgcctgaaataaaacaagctagtgttagtcaacatactggcatccgtgttggagacgcaactataaagtacagttttaatagtacacatgtcatgtacttaccgactaattcagacgagagctttgatcttatgtcgttatcaggcaccttggtgcaaagatataagcagtactggcatcctttctatagcttacctgaaaacataagattccttctagcgctaactggaatacatggcggtagagatagactgaaaataaagtctcatattaataaattttcaccatcacattttcgtaaagacctaatgccggagcatgtcatgcacgggattgatagagttagaaagaagggggggaatgttagagaatacctaaagtttacaggatttacgtcaactggcgacaataacgaaattgacgagataatgcgtcatattgataaaatggggctgtatcgtgatctttcggatgctgatgagttctcatcagtctttgatgtcgtcaagtcatgctcaactcagcccatcttggatcttatctcaagaacctcaccaactttctatacattattatcgaccgtcgactcagaagtgagaggcgtcgtattaactcattatattggcttactatgtgacgaaataaatgtagcgtgcgtgcagcatagatcgagtgcgaatccacgtaattttatccgtataccaatagtgtcaattgaaatgtctttctaataagtatgtagtttgaatgcaacatc

SEQ ID NO: 546 - DNA, 3770 bp, Unknown
  derived from dsRNAs of unknown virus
gttaaattttactaattatttagttcctcatggagccccgctccctctctctaatcgaggttaaattaacagattgagagaattttcttctaccatcttactgatggcgcccaacgggtagaaatttaaattaacaaactattatgtcaaaccccattggcacaattttctcatcattcggtatcaacgatgatgagataacttctcagcaatcatcttggcttttaggcttagcctatgatgcccttagtgataaatgtgttgaagatggaattaaccttaaaattacaagagatgaatttattgtcgaatacagtttagcgtatgctaaaccgacttcagattctattttggagtattacactaagatttcaactgcaatatttgcttcaaaacacgatcctaccagtgcacttggctttgtagcacctttagcactccctgctattattggtggtactattgctgttggtaacgttttctcaagaaatagatattctacattacagaatgatattgttgaagagcttactaaacaagctggtcaagcagtccttactaaagtcgatagtctactatctgatcttgcaggtggtatacttggtggcggacctaataaaccaggaaagccagctccacccgctagtggtggtggtggtcgtggtgaaacttacggtggcactggttcaactcaaccaattggtgcgaactttgtcaactatgttcacccgactaagaaacttgagtataatcttggtattcccaacaccttaagaggtacggaaccttttgactctagcataactaatattgatggtgttgtttctagttgtttgactcttaaagttatcaacttcaaacttcctttagaggatgacacattcaatcagtattacactaaagtttggattccttcaattagggactatcttcaaggtgagaaaagactaaatactaatttagcttctcttttcactcctgacagaatgcgtgactatattgaaagggttgccgaagcacttcaaatttatcacttctttatcaacgtttttaactataacttacttggtgaaggtttaaattctaatgctggacttagatacattagagaaactatgttcagtactacgaaccttcaaaagttatcgttgctaagagaaagactagatggtttaccttggcctcagactcttgatagtgaaatcgcctaccacggttttatctacactcaatctgatgtcaattatagtggaaacattatgaatgtacctgatatattcgtttccaatttatatcaaacaggtgatgctccttctactacagttattgattcaattcgtgctgatgtaattcagtccacaattgataaacttgatttcaccgatctaactactggagataatagagcgaacatgctgaagatgattggtggtatttgtaacactactgactttcagaactctaaagttagcagtattcaaatagagccatttacagatcctgtatttaatacagagtttgttaacaactccctattctactcaactgtttccgatgctggaagtgtgagtagatataatgacctaacgcttatttgcccacaggaaggtgctcatgattattcaccagtacctttctattcttatactaatgacgttccaggtatgcttcaggcgacatggacagcttataagaataccggcgttcagtggaacggtttctggagaccagttacaaatggatgtgtattaaaaacaagtgctcctgaagcaactgtattcactgtatccaatgtaatgttcttctgtgatgaagtacccaactaccaacttattgattcaagtggtagtgttactcttagaggtgggttcgttcacgttacaccagcaactcaaaactgttggttatctaacaacttcgttgaatacccttgcatcaaccttgatgatactactggtcagtatgttgtgtctaagaagacacagaaaccatacggttcacagcttatcgtcaacatgtcggtgcaaactaactttaaccaaagaactcaatactggaaacagataatggagtctgctggttgggctatgggtagaacagaagatcgaatgatttctagtcctaaacgtactaagagatacggtaaggacaaatctgaagacaaggaagagtaaagtcttctggacctaacaaaattaaattgctaaccttatgtataaagttaaccgtagttggcttactgataacaaagatgagttacctaaaacagcgtacttgaagcttaccaatctaatgaactctatacaagaaggtaatgataccgttattctatctcctattgcaaaaagagatggatgggataacattcgagaagattggatcaagttctattcttcacttgataagagtaactggcctgatgcgctcatcgaaatggaagaatctcagcaagacaaacttggtccgcgttcaatcgccaaaccttggtcggaagtgagaaagtcagtctatgattactttgagtcttcatcaggtaaactggtatgcaacgatagtgttctgtcccctttcaagaccgctggtatgagagttttaagaccgctatccactgagcagacaattcagcgtattaagaagtcaactagttcaggtcttcctttcgtaactagaaaaggtgacgtaatagctgttactatgagtgattcaatgaaagcattgtcgaggttttggcctgccgctatgtatgaacgcactcaagagcaaggtaagactagagtcgtatggggaattgcccttggccaaattttaagggaagctcctttcttctttcctctcttaaagcgaatgtctgactcgccgtggctatcagcactgctgggaccggaagcagtagatattgcaatggatcgtttgattaagtacgccatccttaacgatctatctatcgtaaccattgattttagtcgttttgatacaacggttaaaggatcattaatggattgtagttgggaagttattcgcaactttttccaaccaagttatagtggagatcttgattctattgaatctgattttcgaaacgtaggaattttatgtcctgacggacttgtaagtggtgaacatggaataccttctggttctatgtttaccaacattgttggtagtatctcacacgcagttgcctctctaagcaccgagcttgtagatattaatttgtctcagattctaggagacgatggtgtacatctagttcgttctgaatcagtagatgaattcctggattccttcgaacaattaggaatgattgttaataaggagaagagtttaacgtctgatagatattctatctttctacaaaaactgtttcatccagacatcaatgtaaatggtcaaatcaaaggtgtttatcctattaatcgtggatttaataggctatgtaacatggaacgttacgataactttaaattagacgggataagtggagctgactacttcgcgattagggatctttcgatcatggagaattccaaatatcaccccgcatttcgtgagtatgtcctttggtgggcaagcaaatcgaaatacccaggtataccttctgataaagggattagagattatgtcgaaagaatctctgattttaatggaacagaagggatccttgttaatcagtacggtgacaacatccgaggcataaagacttggaaatcgtaccagatacttagcgaggaatccgcttaacattaagggtaatagtgatattacccccc

SEQ ID NO: 547 - DNA, 3645 bp, Unknown
  derived from dsRNAs of unknown virus
tggaaaaatacccagttcgtttgcatgatgcaaattggtaaaacccgtcacagtcctgacgtaaacactggttcaacccgccgtaagggagagtgggcggagcatttcaactccgcatctttgtacgaaaactacacacaattcgagtctaatatcaacttcgctcgtgagcagctactcgcgattggatgttggcagcagattgaacgtgagagagcaaaaacatacccaaaagacctggtccctgaaactgcctcacaggagcttaagaggcaccatgaatcgtttgttatttcgtacattgccctcctcaagaagagtgagacgattactgagacaatcagtcgagtatccgaaaggatgcagggctcgatctcaggaatcaaagacgtctcatttccgacagaagaggagatcacgacagcaggagacatacctgtatcggtgatcgacctaaaggatactaccatccttgggacccacccacgcgccactaagaagtgggcacgccgagagctcaaagagtttcaggcaagcccaactccctggcagcttggagaagtcatttcccataaagagtggaacaagctgatgcatatcatgcatggcaacacaacacccgtccctggtgggccactactgaagtcagtggcaaaggtgatacccttgaaagaggcggctccggtgcggctcccacaggatgatcttcccgaagctgaagaagacaatgcggatgacggaactatggaatcaatccgtaaggagatgatcaagaagctgaggagtggcgtggtcaggccatttcgtctacagcctgtggtaaataaggacacgggggtgacctcctacaaggcaccgaatacgcaggagtgcttgcgtcagtggagtgtctttcaggagatgtggtcggaatggtggattgctgcccaggtgatcactggcgagtacgtgagtccatttgacctttttccaagcagcttcactttcgcaaagcgagtggtgactcctgactatacgaacttactgtggcaaaacttcgtccctatgttggcagtcaagtcagacgatgatgactcatcactcgggtacaacgcaaataagggcattgacttgtacagtcaaggcattcattggatatttaaatcagagcttgagctcgtgatcgttctgctatcgatcttgctctccaaacctatcttactcacgcagaaggaggttctcgcgatggctactcagacgccatcgatgatgaaggaggcaaagagtgtaatatctcagattaaaatgttcctctcaaagatcctgaatgcaaggactgctctgcgtgacccgagctatggtgcggtgaagaaggccttcagagaccgaaggatgttacttgacgggcagatgaaggccgtccgtgctcagctcaaaaagatggagaaggacatgtttcgtctgtcagttgatgaggacgaggaactggccaagctggacaggaataggaagcgtaccaaagtgtcaatggaggaacgactactttccatgggtctcaatggccttcctgtcgcagcggaggaccttcagaagggtggcatacaaaacgtacctgagctagacgcagacgaatgtgatgaagagggttcagatgcgcgtgccctccgccaattgatgggtgaatagggtttttgctccgggttggaaatgggtagggtggatgaggctggggacagtgtaagtgttgtgtctagtttaatgagtgtgactgactcctcggcctctggtgtacgtaattacgattgggttgtaaagtatagggaatttaagggagtgcgctccgtgaaatcattaccacttcttgggtttcacggggcgtgcaaatacagttacatggagccgacgactattccttcgtctctgttccagtctttctacgctaaagcagagacttgcgcacttttatgggaggaatcccctgagggtatttggacaaaagaattccgtccacctagtgtcagcgatcttgcgatgcatttagagcgctttggtggggcgcgtgatttcaacactagtttcttcgacgcaaatgtgcgggaaactatgactaggatgtcccggattgagggggacctcccgacagtcctggttgacacgtggctcaccactgataatcttcttcgcgtccgggttccctcgaacacgtcagctggaattcgatggaaaaagaaacaattgcgagctaaagttgacgcactgccatacgcattagaagaggctgtcagggacatagttgggttgaaagaaggcaggccttatagcacacccccgtgcttttgtgccgctaggggtaagatagtagacatttttaaggggccggggaaaaaggaaggcagactcgtcttagttccagacctgaaaaggcatttgatgggttcgctcacatctgtaccatactcaaaattagtctcctccttctcaaagaagggtggaggtgtcctaatcggaatgggaaattaccacatgaactactcccaactggctgaggacattgcgggaattaagaagcctgcagcttacttgtgcgtggacttttctggatacgaccagactgtaccagctgaagtcattcaatggggtctcactagaatctcatctcgtttcaaaacttgccaggggagccatgcctactggaaatccgaactcaatcacctagtgcacactgaaattgcttttccaactggagaggtttacatgaagggcaggggtgttgcgagcggggatccatggacatctcagcttggcagtgaggcgaattggctaatgcaggaacttgcttttaggttccttgggtggaatgcgcgtgcatggacatttggggatgatgtaatcgttgcaatagattgtctcccggaggggcgtccctctagtgcaacattattgacccagtatgcaacggcgatgggtaagttgtttggtttggaagttaagggttcagattcttactgtacacctcagctaagtatttcgggtcccgagccggttgaagggaagtctgtgaaattcttatctaatttcttcatggaggttggggtcatcgtacccgctccggagtttgcaaagactcttgagtcaatgatgtaccccgagtataatccctttacaaatgaacacactgaactgaagagttgggaagtggaagaattgctgagctttgagctcatgcgcacttcgtgcctgtatatcacgagctattggaatgaaagctcaaggcacctactagagcaataccacatctggttgctcaaccttcatgttcgcccaacccccattccaacctttaggctcatgcagcaactaactctctgggaccttgactggactactttcaacagtatctggttgacacacttacccagctatgctgatatcctgaaactgtacacttcaattccgcaacatgatagggtagacgtcggattggctagagctaagcttagcaggcttaccactttccagtcccggagcacatgagtttggggggagctacttcccctcgcgtccaacggccataaagacgataaaagtttggtcttgacgggaccaacataacaggatgagtgatagcagtagctcgtcaactggaacgttggagccccccgccct

SEQ ID NO: 548 - DNA, 3489 bp, Unknown
  derived from dsRNAs of unknown virus
gtaaaatacattttcttttaataaagtacccagttccctttgggagccgcccgcgagggtcgtcctcattttatgaggaattttacaggtagtgggcactacctacttaaccatttgattatgactgacacttccaagtctaaatcggtggatccaattgtagactatgcagatttcgtccgagatgagatttcgctaggtgttgcaacttgggctatccccgactttgatcaatttgtagagatccggaaacagctgtctaacaaagacgctcctttaaagtttgtctcacccggcaaccttggaggcttagcaggtgccgcgatgtctaatccttctatccgtcgcatgatggatgccggcgttgacgccgtttcaaaggaaggcgttcgaattgctgaaaatatagccagacggttatctgacggtgaatcgttcgtgaaaattaaacgcgattttggtgatactggaggaaactctgggcgtgatgctggtggagatggatctcccggtaatccgttcaatccaaaccgcatgaactacaaccctaaacctgttcaggttcgtttagatacaggtattcgctctaagggctatggtgattactatccagaatctaaaccgataatgaacgttctggacctaacgcaagtggagtttcgtgtcccacaaaatgctgcttcagaacttaagacttatttcgatactgtcataacattcaatttccagaatgacgctcaaatgagagtgaattttaatgtcgatgctattaataagttcagtgacgcgaatcttcgtgcatggatggacaggtatgcaatggcttatggaaaatacgtttggtacacttctatcattaactattgcaacgaaccacttcaacagaatgctggtatgcgcgctttaagaagcatgatgacgcctcagctgcttgacgatctgtcgcagctagccaacatgcttgatgggactccggctcctccgaagttccgtgaacttgttcactttatctatggtgcgccgttcaaagttagcaataatcctggttcgcaaatcagaatgatatcgccttcggttctccaatctacaaatgtaggtgttgaagtacgtttagcggctcttccgcctgacgacatccaaagtgcgattacttctatgtttgccatgcgcgaaacgacagctcttatcgctcgtgtatgtccacaatggattcctggtaaagacaacactcctgctggtgctgctgtttgtgagtactctccaaactggtctacactatgggagaacctaccttacgatgtattcgcaaatggtactgaacacttcggtcctcccgttaatggtgagaatgatgatgcttgttacggttccacagctgatacactagatggtgctgttacagcattatggaatggctatgactctacagtttctggtagttcagtgtttgatagattcagacctggtactataatacctcgttcaagcgctgcgcctggttccgacccggcgataacgtctttttcgaatagaattcaattcaaatatgattctacgaacagcacttctgcgttcttcctagtctcagttggatcgaaccagttcaactacatgagatgtgaggcttatacggttacgggtaatggtgttgtgcaccagattgtctggccaggtagagagacaatcaacaatattaacatcgcttctgcccgtcagacttcgtatgagttatactctatgatgtttgatatgggaccgagcactaacgcttcatttaaccgaagtgaaaaacgtaaccctcgtcgcagaggtaagtcgaaagttagcgcttcagataacaaagaagagatttaattaactggaggtcactatgcaaattgaaaagctatcgcaatcttatctggtaagtatccttgaggaagagaaaatcccaacggtttcgaatgcacttcagttgttgcgcgaaggtaaagagcctacacaacgtagtcctctgttcaaagataagggtgaatcagcaattgttgatgattatctaaagatactttcccgtaccactggtatcactagtgatctctacgattacgaagtcagtcggttaccgaaagttggtccacaaggcggatatccaccgtttgacgacaggaaaagtagtttcgaagattactacactttacctggttcgatcagctatactgacaacgaaatcgacgatctcgctactcgagtaagagaccatcttttcagaggaaagaaagatctcagaccttggtcatacgatcgcgtcattcgtaaagggcaacttggtggcacacttgacaccaactctggttgtccatcatatggtaaacgatctgatactacgattcaggcccgtgctatcagagacgcgagttccggtaagtggaaggattacccagcaatactcggatccagagggcagagaaattccgataggtttattttcatgttccctttttcgactaaccttattgaacaaacttttgtcaatacagttcttgatgctattagaattaattcaattccaagctttagtgcatgggaaggttttgataaagttgcattaactctaactgaacaaggggtttcgagtacgaagaccaagtgttctacggactacaggaaaatggataaacactttggaccagaccattttgattttgtattccgtgttctggctcctgtatttcagccgtctatgcgtgaacaacttagagagagtcttactcattgtagcgagataccagtattagtaagtactgataaactttacactggaacgcatggcatgcccagtgggtcaggttggaccaacttagctgaatcgattgtttcactagctataatgataaccgttgaggatcattatggagaggatgctattaaacaagttcttggcgatgatggcgtaatgttatggtctaccgtaatttctgattttcctgatgtatttgcagaatattctttaaaattcggactggttagttctcccgataaacaaagagtagatgcgaaaacttttacctatctgcaacgtttctttgatgttagaatcagaacacaattaaacggtaagaatgtcgtggcaggtagttatcccggaatactagctttaaattctgcgatgaacccagagcggttccacgacccagtcaaatggagtagtagtatggagtcactccgatggataatgattttagagaatgttaatcagtcacctgttttccacaatctaattgattactttattaagggtgataagttcaaacttggacttgtgatcccaggctttcttaaacgagggatttctcagtcctatcagacagctaagacacttaaagattttgttcccacttacacaaagtcctctactgagaaggggatccgcgattttgatgtcgtgaagtatttgagaacactacgtccacgctaggggcgagtgtcggagaagttcatagaacttctctc

SEQ ID NO: 549 - DNA, 3486 bp, Unknown
  derived from dsRNAs of unknown virus
ggattttattaacctacttttaagtctttaagtaaagacgaccgggattacctacccctattggatctagcttcggtaaagaattataagagagctacccatttgaaacccttacctcagactaatcatggaagagaagaactctgaattacaaggttggaattacgttgaatcgtatgaattctttgatcatgtacgaccactgctatctgactcaagacttgagtatcaggattggttaaaagcaatcaaagcagatcgagataagcatcagggaactgatgtagtacatcagcttggattttcaggtctacctgttagaccctttactcctgttaacactcccaattcaatccctacattttctggccctttcacgtcagtgatgcctcggattaatgaacaacttgaagctacagctgacgaattagttaatgctggagctgaatttgttcaagctcaaatttctagagccggacaagcccttatgtcgcagttcggtcaacagattggaattgaagttggagccggtggtgatgggggtacaactaagggcgattatagtggaggttctaattataacaaacatggcttaagccttggagctcagccaatcaattcgtcgtttagaacgacaattgtacctcgttacagaccgttgtattctaacgacggtaatgataatgatgcccctctagtaatgttttacggagaggttttccccgaaattggagatggggggggtaactttgcaggtgacactaacttgcaacgcttcttgaatatagatgttataaatcagtggtcgactactttagccaggaaactgagacttaactcttacactagcactctaaatactaaagaatatatctttaatttcattagagttcagatgcattgtctttcgatttattatttctttgtgagcgttattgcgcacattaatgttactgaaaataggaatacaggaatgatcaagctttacgaagctctctctgccgaagatcttcaagagatcgcccgcttagaacttctgttaaagaagactccaattgatcctaggattaatcagtttgtgtttcacttgtacaataactacaagcagtctcacttaccaggagcccctctttataagatgatccctgtttccttcgttgatagcactggtttctccacttctagtttaaagtctggaagtgtagctgcagctatagacatgttgggttctagacggtataagcaattcgttgagggttacgttcaggctttccctgatgttgattcacaactgctaatgtatactggtgttcctaattttgacccagaccatctgactttcgtcagaaactttcctcatataggttatggttcgacggcttcatcagccactacacatctccctacagcagccaatcgtgatgagaagttaacttacaacttagacactgatgctccagacggctggacatttgcgtctagttcaatatgggttggctctaatgatcaatctggccttaagctgtcaggtggtttcggtggtccgaaaactttaggtagtactgatagtgatggttattaccaaaccgaactcttggttactaaccttgttcacactaacgcagttaaaactactactatagtgttttcggatgctggacaaagcgaaccggtgtttacatcgcctagtacacatgagacacagtctgatattgtttcacagacctataagatttgtagatcttataatgttgtgaacaattaccaaagacatggttgtcaaatagcaacacccgtttcagtctcggatatggaattgacttctgaggaatttgcgaacttcttgtttacgcctccaaatactactgtggctaccagaactcctagaagcgaacggccggataggcccaagaaaactaagaacattaagaaatagtacttgttatcgttacctaattgccaaacatcatttatgcaaactttcgacctccgagattttgaatcttctttcacaaccaacggatttgagaaactttccagaagtaatgccagaataatgaagggtagtaacttagttctgattactccagcagctgaaagagctggtcctactaatatctacgaagcttggctcactgagttcgagtcttattctgaagcaatgaaccctgacttactggaactggaacgagagcaaatgagtaagtttacacctcgctcaattgctaaacccggtagtcagttaattcctggtgtttacgacagtttcgaacccgtcaagataaacacaagtgggcttagaccgttcagtaatccgaacgctaacctacgacctcgttctattgaacacagcgctcaggcaactagatctaatactcaagctgggtgtccaaccctagagaagaaaggcttagaaagggaaaatactgtgagacattttgcgtcgttgtactctcagaatcttacacagatttgtgcaattagaacgcaagaggatggcaagaccaggattgtttatatctatccttacgttgatataattcaagaaaatcgatacttccttcctctattttccgtccttagagagcagactgaattttctgcttttaaaggtcccgatgctgtagacttagctgttactaaattgctcctaaaggctaaggacaatccttcaatggtttgtgtctctggagacgtttctgggtttgatgactccgtcaagaaacaactgcaagaatctggatttgcagaaattaagtcttacttccaagctaattacattgacgagctggatgaaatcgctttgcgattcggcactaagccgcttgttttgcctaacgaacaagtgcttgtcggttggcacggtattcctagcggttctaactttactggaattctaggttctgttgtaaataggcaggtcctgaattcgactcctgacgattgtcaagtcatgggtgatgattttgtagtcattaccgataatcctgatgagattttcgctcggtacgaacaaaagaaattgaacattcaccccactaaaacgaaaattaaaccgtcgagctttgtatacttgcaaagattacacagtcttgatttgactgtagacgggctggctaaaggggtctacccaacgtttagagcgttaactagacttgtgtaccctgaacgtcggtcggacttcgatgattatggtctcaagggtcgggattattttgcgatccgcagtctgacaattttggaaaactgcaagaaccatcctctgttcgagaagttcgttaagttctggctgtcatacgaaaagtacgtattacctagtaagagttcgatccctacatacgttagaatgatggagacgaaaagcgtggctctaggtacaactaaccaatacggtgatgctgtagaaggtattcaaaacttcgaaagcttcaaaattgctagaggtttagttggataaaagcttacaggcaggttctttactgcccc

SEQ ID NO: 550 - DNA, 3440 bp, Unknown
  derived from dsRNAs of unknown virus
gaatatcattggtagaatctttaaaaacagatgtcaaacgtaaccgaaaaatataaaggtaaactcccacgccctgctaaggaccaaagcgtcaaagagttcgaagaagaggaaatcaagccagatgccgaatacactgaatttaaaagtgtgaaggacattttggccaaacccgattatttcgagccaatcattaatacaccagaattcataagtatgctggagaaggaaggaattgagattccgaccttttctgcaccaactaaagaggtaaaggtggatgatgataagaaggaaaaggcaattaagcaggaagaggaacctaaagaatcgatgaagaacactgacgaagaggaacccaaggcatcaattgatgttgtaatggtaccttcactggaggaaatttcaccgaccgatacaatgagtccagttgaagaaatgccatctaaggcccacttcgaaccagtatatcgcagaatcgtacacccgttaactaaaccagtatcttttgatgttacacatggcttggcgactttgaataatacaggtcttgaggacatgtatatcgattacagtggagatcgaacgacaaagaagggtcgtgttcttttccggtggctacagacgtataggcctatgggcagagttgaatcgataaagtacgattcctcaacgggacttgtagattcagcgaatcacagccacgtttttacttccgaagtcgcaggtaacagcgcgatgtcacatgcgtatgagattaactcactgcgacccaaagtggaggtggcgcaaccaggcttcagagcaaacgtatttgccgatgcaacgatacctgatgtaataacctcacaagtggatggacgtgttatcgatttatcgattaactcacgccctattggttcgcgaataaagtcagcggatgtgataatgaacccatggcgagcaccaattatgcttcgtgatatggctgcgtacaattacatgactctatccttcaacgattggaaggatgtccatattgattacattaatcagggaatgctgagatatgtacgtgagcgcaatgctaaggagcgggatgtaatcactaatacaacaatgcagaaaacggcgtacgatagatacatcattggtagtgctggcgcaaatagcgtcacgtactactatgaaacgttaccagactacgcacccattctgtgtgaatccgttcttggcagatctttcagtaaggcaagcgaagctatgtccacaatcgcaccctcgcagcgttcaatttcaacgaacattacaaacaggcaggcctcaagcatgctattaaatctgacagcggtacaaccaagtgctggagcgaacatgatgcgcgatcttggtgcctacctgctcggtggtaagcgtcatgttctggaagttgatgtagatgatggggctacaaagacgccgttgctaaacgccttgagtagcatagcgtcgttaattgtactcgatagacgtttcatggatgagcggagcaaaaggcagctacttgtaaacgtactccttcccttctatgatgagtttcctacaaggcgaaacaacgtaagagatgtttctagaagcgttcatgaaatcgctgatgacttcttagcgaatgcatctacggctatcctcccggacgtcacaaaaatggtggatcttgctggacgcggtagagcaaaggggcgcgaaatcagaatgatattgcaagatttactcagaaatgttatggtaactaagtttgaacaacttggtgtgacggataacatgttcaagaccggtgcagctcgtccgtatatgccgttttcgtcacgtgacgatatcaccgacatcgtactctttggtacccgaactgacggtgaagaatcacgcatgcacgaaatggcatcctatcgccctggcgctataagaatggcgaacgcccttgagaggttctcagacgttcttggacgtcttagacaattcgacgggctggggttggctgttagtgaggcgatgaagactagttcgcatttgcctgcatccatggctatttttactgactctttcgtgcatggatcagttcacactgatctgctgcctgcaactactcaggtacgatacgagagatcagttggatcgattgtccttccttttgatggcgcactatcattcctgctttacgggattggatcttcagagatgtcagcgagtaatgactcattcgttagattcaaatcgctatcctctccaacaatgccttcattgtatccggcatacctgtatttcgaaagagcgattgtgggcagcgcttacgctgcattcaaggatgatcttctaatcacacacttcgacatggtcgtaagcgtgtgcctggacgctctgaaggtgtacttcaacgccgtagatcctgaatcagcgagccgtatctcatacctgttcgatgagagggagacattggaaaacgaacacctggaactacccgcctcccttacatcatcaatcttctcaacgcatcaatacatgccaaaaatgggagctaacggaccacaaaagctacctggatcgtttgagactaatgaacaaatacatgaatcaaatggcatggtgaacccctacaaggattcacttgatgcagctgataagataataactaagatgtacattgatttcaagcctcttgtcccaattgatattgagacgtacaaccagggcaccactcttgtttacaccaaaccaagccatgatgatgcgcgttatttaagcctaaaagaaatagtcaaagaggcaaggtacattgattccttagaattaagcattgatggaattaagaatatggccatcgcccaccttaggaggatggaaaatgacgaggagatcgctatgtacgatggtgtcatgatcgacacattgatgactacttttaagttcgtcgagcataagggtctaagtgatatgatagtggatacaccaaagatcagaattgataggaaccctcgtatgcttgatactgacttcgaagtgtcagaggtgtcgatttattatcatcgcgtaacggataggcagggagacctaagtgacccagcaaaacgccgtgagcttgattatttgagtggcttcctaacttacgtgagtgtaagcaggaatgaaatccagaaaagtttaattaacttcgatcacgtggatcctatggatccgtcaatctataaggttattagagaccaaaacgaaaatgtccgccttgaaccgaacgcgctttctagcgtccgaattagagatgggcgtggaattacctatgccggtactatgactctgtctactagagaatccgaggacattggaattaccacatcacttaacccaaaggaagagttttgaggtagcaccatgcactcatgggaaaagattttaaagtaaaaggattctatacggaaccaatgtgaaacatc

SEQ ID NO: 551 - DNA, 3403 bp, Unknown
  derived from dsRNAs of unknown virus
tgaaaggtctcgacaccgaacgggtagaccttccaccagagcgcggctatagtcaccgcgccctacaacacgcctttcaggcgtgtcgaacgcacccgccctactctgtggggggagaacgtagagcctgaaaaggcatacgggcttctaggtgtggcagctgctcgaggagggtatccgttgatacgcgcagtttttaccacgcgcgactcgacggatcagagccagctaaaagctggtgcgataggggacagttatggtcctctctcttcctccgagtggctgccacacctgtgggtgcgtccggtcgacccctcttcgagggatcgacccagatatatcaagcgcttcggcgcatcaagtgacggcctcccaggcggttacgttctgaagccattggaggtcgacggctcccatagcaccgactataagttggtcaaagagcgcggcttagcaagggagggccaagagcggccgggccactgtgtcaatgctgacggaagtatattcgtgttgggaggggcacgctcggggctgccggccgcagagttggccaggctggcggcctgtggggcgtccttcttcgtagatggcgcagacttcggtgattttgatggcttagtgctcccaccacgtcactccgtacatgggtgtgctcagcacggccgtgacgacgatgagcacctcgaatcgtatgtaggtcatgtcatcgatcgtgacggaatagagtggttggtcttgaaccacacgaaagacccggccctcgatcacgatgtttttgagaacgtcatcgctcccgtccagcagagtgaggcagaccttgaagagggtagtgtcatatcactcgggttcggcctcggggacccgaatgttgcaacgtacaagcgcatttccgagcgggttcatgagctgggcaggctggggcacgagctcgtgcagcgtcttcctgtacttcctagttctttcactcgggatgggctccagtcgcaggcggccgcgtgcgaccgagtagcacgggagggcgatgagttgggggcttgcgctctctccttgttggcgtgcaagtacccagtgcagctgtatctgtccccggcagcgatatcagctctcgcccacttagccctgcgcccgatagacaccagcctcgacccgatcgagctggaacgcgagcgcgagctgaaaccgttccctctcaagagccacccgggcgcggtaaacaagacgaacacgttcttctcggaagtgtacgaggagtactgtcgtcgctcccctaccagtgcgagggttcttcgcagttactcaggagcgatgcgaggtcttacaaacgaccaggcttgcgccgtcgtgttcatgtgcgcacggttccacaagctcttgcaggacccagtgcagatggcgatccgagcgttacgcgacgctaagggctgtacggacctctcgacgtgcttaaaggggcttggcgcgaacgggagtgtcatcggcgcgtctctatgcgagatgcaggttctgcagggtcgtgccaccaagcttatagacgttgaggcgaaagcccgcgagcgtctggcgtcgaacggccgagtcaaacccgcgatacctgacgccaagatgcgtaccgcgatacgccaggttttgctcgaggaagtcaacggccatgtggagttcgacgatgtggatgacttctggtcctctcggtgggcgtggtgcgttaacggtggctactcgcgggcccgtgagcgcttcagcccgcttgacgaggccagtatcagcgggcgcttgcaccgtcgagcagcaagtgaaagttgggccgagaacatcgtcaaacggtgggacgggagcgtgtacgtaacgccctcaccgaagctcgagcacggcaagacgcggctcatcttgtcatgcgacacgctcagctatatggccttcgaacacttacttaagccagtcgagcgtaagtggcggggccgccgggtgatccttgacccgggcacgctgggcaccaccggcacggccatgaagatgcaggcaatgcaagagcgagccggcaaactgcgtgcgatgctcgactacgaagatttcaactctcagcactggaatagtgtgatgaagatccttttcgaagagctgtgccggcacgttggatacccggcagacttggcagcgactatcgtgaacagcttcgacaacgtcctactggtcttaggtacggagctggcaggcacgatactcgacactctgatgtcagggcatcgggcgacaacgttcatcaacagcgtgctgaacgcggcgtacataatcgccgtgtcaccgacggcatgggcgaagatgacgtccatgcacacgggggacgacatcttcgctatctttgccacgatcgcggagttcgaagagcttgtcgacgccatgcgcaaggtcgggttgcgcttgaatccgatgaagcagagtgtcgggtacataaccgctgaattcctgcgttgcgccgtcactgacttcggcgccatcggctactacccccgtagcgtggccagctgtatcagcggaaactgggtcaacgacaacgcgctggaggccgaagaatcgctcaacagcatgttgaattcggcccggtcactcatcaaccgcgcgtgcggccagcacttggtagccttgctgctagtgccctccttgatgcggcaaactggtttgtctcgtaccaacatcgagaatttggtgacggggcggatggctttacgtgggggcccatgctatagccagacacctgtgtaccgctcagcgagcctgaaagttgtccgcgcaactgagaacgtccaaaacgacctgcctagccacgccacggaggactacctcacacaccacgtggccccggcggagcgcctcggactcgagttaagtggggcgaacgtcacagaagacatgcgggcctcgtcctactcgaagtcgtttcccgagttgttcggcagtcgggtaaagcccaagggcggtgtacaagccgtagcacttgggcgggagactttcgaaacgcttcgcggctcggaggtggcttggcaggtgctgcgattgaagaaaccggaaggagagctggttaagtatccgctcctcaatttgataaagagtcgcctctcgaggtccgacctagcctcgatactgttcgaggagggaatcgaagtcgagaatgatatcgaacgtcaatgttggggagttagcaaggaagggtgtgtcatcgatgggtttctgccttattcagacgccgcttcgctgggatcacggagtcagacgcggttctgctaccagcgttacccaatctacttctagtcgcctcggtggctggtggtgatccgagctgtgctccagcacagcgggtcgacatagtcgactaatataataacgtgcgctttgcgcgcactatgcg

SEQ ID NO: 552 - DNA, 3330 bp, Unknown
  derived from dsRNAs of unknown virus
  misc_feature (1078)..(1094): n is a, c, g, t or u
  misc_feature (1966)..(2114): n is a, c, g, t or u
tgaactttaaaagactatggtagcagtatctgtgttaaaatgggtattccgcttctttatttacctaggtaaataacgcgtgttcatcttatcaggtagctgatcaattctcatcgctagtttgttattgaatgggcaattcaataaacactgtggtgccgggggaacttggtagcatcgttaagtcgatgtcgtttatattaatatcttttattattttacgccggccaaaaattaaagaggataggcgtcattggcttgatatggcgcatgatgtgggaggtaatctaggaacgtacgggaaacccttgcgactgactagcgtcaactcatgtgacggtgtgatatattttcatatcttctgacaccatttgtcacaatgccttacaaatttagaaccagaatttaagcctaattctgttatttaaaatgaaatttaagtatcttacaagctcttttgaagttaatcttcctaataaagagaatgaaaatgattggattgtagttgtttctgaatcctcttcttataataaggaagaagttttagtcaatgcctttgaaaaggactttccagaaattaaattaattggaaatgatgttagtagtaaatacattttcctaactagtgttactgctcgttcaaaagctcttcttaaatggtatgctgcagcaaagctttcttattctgagttaacacaacttcctctttatctagctgatcatgttcatccttctgaatttatcaaagttagagagaaagctagtgaaattaatgtagttgtttcagaattctcaaagagagctcagtctttagctagagaatattctgaaaaacttaagaaaattgaaaatgagagagatgaagctatatctgagataaagcttaatgataatttaattaaaatagtaactcttcaggttattgatttaccattatcaattcaaatgtcaattgaaggttatgccccaaaagacattagcagagatgtatctgaatcacgtcgtgtttatgctcgtgaatgtttaactactttcaaagtatctttacttaaactaattaatgatgaacctgaagttnnnnnnnnnnnnnnnnntaaagaacttggtttaaagtaaaagagattagtagtttaaaattactaagtgatcttaagaattacaataaaaaagaaagacgattaaaaagtaaggtttgggcacctcattttaattcagtatcttatggaaagaataaacaaaatactgaatcgaaaaagaagtctaaatctaattttaataagattgttaataattttttagaacaattaaattatactactcgtcgtttttcatatagatttgagaagaatcttagacgtactgttaaatcatatccaatttatagactccttagaaaagatagaactattttaaagctttatagaagagtaaaattagatgattttaaaaagcattataatattaataaaactaatagagtagttggatggactccagaatacgttggtccttcacatagtaaagttgttaattcttataattatgtaaataattttatcactaaaaagtttgatgttattaaggaaagtgtatctgaatattgttttgatgacttaataaaatctgctgctgacgatagaatggtgtattcagctggatatgatacatgtcatggacatcttaaggaatactttaaagatgatgatattgaatctctttattttgatccaatagaaattattaaaatattagagttttctaattttagatggtttagggcaccagtatgtaactttaatgacgttcgtgagttgtttactatggttagaactaatctaaaagcattctcaggtcattatacttcacaattatttggaaaggaaaaattacattctgattttgcttctcgtagaattgctagttcgatatatgagaacatgaagaaatttccagttaaaaatttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgattggaatagaacatataatatagctggagaatttaataatgaaaaattttctaagttacttaagcatgaaaattattatgattttattctagaagctgactggagtttttacgactctaatatagatagtagcttcttattagttgctggtcttattatatgttccggtttacctaacgatcgtcttcataggaatattagatacttaataatatctagtattattacaaaatatgttgtgatgccacctggcgttgtagttgagttgaacagagctcaaccttcaggtcatccatttggaacactgattaattgtaacgttaatttaatttattggtcaattataggttataagatatacggaaaagattatgctaaatatatgcgagttgaagtatatggtgatgatactcgtgcatattttaagaatcacaaaaatctaaataacttagatcaatatgttaaggaatgtggtttaaaaagtgagattcttaaagacaactttagatctactcatgaattttcagaaaagaatgagaatattgattttttaaaaagaagatttgatattgaaggtgttagatggaatcataaaaagatgtttgatagatggttatatcaaagcaaaaatagaaatattgatgaccagatattgttagtttcatcatattatgaatccgttccatcagacaatgacgttttaatattagttaagttattcactaagtttatgttagatgaatattcagataagttatcttatgatagcattaaattttgtgaaagctactcagagcataatcttaaaattaataatgtgagaaatgaaaagttcttttcatattataatagaacaaaccatagtatggagagttttaataaaataaatgataccttttcatattcttgtatgatttataaacctgaagaggttattgatcaaattatagttaggaatttgaatttagaaaaagttcttcattcattattcttttgtgccgaagatgttctaggtacaggaagatcaccaccatatgatccaatttctgattttgagattaaggaatttactaagtcctattggaatgataagggagttgattctattaatttcttaaaaagaaaatttaatttaaaatagattataattattattattataaatatattattatgatactttgactcctcactatatagtgaggagttca

SEQ ID NO: 553 - DNA, 3004 bp, Unknown
  derived from dsRNAs of unknown virus
  misc_feature (1)..(1): n is a, c, g, t or u
natcaaccagtggatcctgtctttacaggcgtccgccctaactgtttggtcctaccgaagtagaaacacacgcacatacatgtcaactctcgatgacgaactcgtcacagccctgcgatcccagttcgcggagctggctacaactcctgtgtcagctctggcacagctgctgggaacacccaccgtcgcgccatggtacaaggaatacaagtctaagcgagccattgctgccgcgctcccagatgagtgggcggaggcaggcctcaccggagacatgtgggcattcgtcaacgatgagcgctcccgtcgttccgccatccgcaagatccatgcagaggcaacccaagctctcgctaaagagcacgacgctaaggtccgcattgcaaaccagaagcgtgacgacgccctcctcgactgctcctctcccctcatggacgttctcgaacttaacttcgacagcctcccactcggcgcccaggccgtcattgcaggggcagcggacaaagagcagcgcaaggtcctcactgagaaggccctcgcccgtgcccgcaaggcgaaactcaccgagctctaccccccaggcaccgcattccagaagggtgtcgggcctgccgctccccaggcctagggctctggcaagccgagcttcgttaacggtacccagctcggtggtgccgttgccgggttcgagtatattcacgcaatcgcaagaatgcgccacctttggaggctgcatcgaggagagtttctccagtgtgaatggatcccgaatccagacgaagaagcagacagcatgtttaggaatctcgtcaggggtaaagttaagcagtacatggatgaggcagggggggtcagggaggggatggataagaaagacacatgggttagtcgcaaggaagcggctaggagattacgatataccgccactaaggccagaaaccgggaggagccagagcgtatgtcagcactcgaacagcttcagtttcacatttaccccggcgcagttgagcgccttgcagaggggatggatggaggagggctcacgcctcacgaaattgaagcagtccagtactgcagccgcactaagcatcccgacaataaaattaagcaacaatctaaaggacatacctatacacaccatatatacgacggcatccgggctgtcccgcggaccgtcactcgcaacagtaaaggaaccactcctgctgacgcggaccgacgagctgccgccaacgccaataagtggctctccgacatcaaccgcgacatgtccgtcatcgccccgctcagtatcaaccctggactgcatttcctcggacgcactaacatcaagcacggaatgcgacccacccccgcatccaagaccgcggacatacccagggcgcatgccgaccagtatttcgcggacaccgaccctgcccatgacccatcccgcaccattgtatttccagggaaagaaacctatcttgccgaccttgaaagtaccctcggtgaccccccccgtcacacctgctctgaagcagccatcaacaaagcagtcaagcattattccggaaatctgggattgcgacgagtactggacgacgtacgatggcggcaagtcagcgcgattaaagttaacggcgcagctagcagcggagtcggcttatcggggatcggtgccagccgtggacagtgcgcgcaatccattgaacgactggcaggacatgtcgtctctgtagtaggcacgaagcctgtagcggggtgcggactgtggcagctgggggggaggggcaagaggacgacacccgcgccaggtgacaagctcaagagtcgggctgtcatcttcaacgatggcgtaaacgcggcggtgtcgtccactatatcgcagagcgtgggggagtccataaagtcaggggagggtagtatcaagatcggtcaccgcgccatgcagggtgcgaagaaagataggctcagcagtgagtcgcatgaagtagaatttgagatagaccacaagcggttcggattcagattatccgagccccttctggtgacagcatttggaatgatcagggcgttgctaccgcccggacagtactgggactaccgcgtattacacgagatggcccattgtatcttgaaaacgatcatccttccaggtggctggatctaccgctgcacgtttggcaactggagcgggccctggaccagcatacttgacagtttctgcaactggatcgcagtaacaaccgtactaagtgagatgaacttcaaatcggctgatgtcgacccttggttctatggcgacgataccctcatagggttcaagcataacgtcctccccgcgggcgtcaccccttccacaattcaggatggattggtcgaacttttcggaatatacgctggagatgccaacactgggcgtctatcatcgtttggtacggagtccggcgctaccttcctgggtgtgtggaataaggatggcttccacgggcgcccaatgtcaaagtgggtggatgtgagcgtgcaccctgagaggctacgtaacagccctaaagatcaaatgaagagaatggcttatcttggtcacgcagcagtgtgtacccaggagaatcgtgactacttcaccagctacttccagtacgccaatgaggcgttggacgaggcgatccgatacccacccgaaaggctcaggcaatccctgaagcgttccttcgacgaagcccatgcgcgatttagcgacggcggagaagatgtgcgggaatgggaggtaggcgccaagacgacactcagcgaactgaagttgccttgccggaaccaccaagccgtttggtttggtccaggtatcggccgacccggcgtacgactccagactcatccaaccgtgacgtggttgtctgagctggttgacgacgttcccattggcatctgcgggattcatagatcggatgtcagcgcgatttggtcgcgcacttcttgagcacctgcatcgtaagcaggacagtaagactagtatatactagca

SEQ ID NO: 554 - DNA, 2896 bp, Unknown
  derived from dsRNAs of unknown virus
  misc_feature (1)..(4): n is a, c, g, t or u
nnnnttcgtgggggcacagagccgcgaatactacacggccatcgagccatacccgacgtacatcatccgggctgatggcacgcctgcgcacataaccggtaaagtcatgctgtcgccggccgtcgagcgtttctgtcgtgagggactcgagagctacgcgcagggggacgagcagttcaggtctgtagacatcttgccgacggtcacgtcgatggggagctgcagagtctgcctgctcacgcctcccgtggcacagccggggccgctgggaacgcttggtgtgtgccatcaaccgcgtggggcggcagctagctgtcgcaccgacatgggaaccgagtcactctcacgtattggctcgttttttcgaggcctttaagggaatcgggatgcgagcacctacgcgcgggtggtttggttacgttggatctacggaccgtgatctgcagcatctgttacgcttggttggggggagcccgtttctccctgacaaacaacgagccgcggcagactggagagcactggtacgtaagactgttgcacggcgcagcgggggcgtgaaacgcacccgctgggatgaatcatggatggcatctttacagcacaagtaccgtgttgtgggttgccaggctaggtgccctataggcggaggcggggcgaaaaagtgcttagatctcttgtgggacctcctggggccaagagtgcgtgtgagcgttgaacgggtattctcggagatggggatacttggtgagcaggacaacggatacctcataccgctgctcaaggaaatgggagacatggcaaagttgcatggagacatgctgttcaatgggttctggcagtatttggtcaactgggaattgtgcttcggcgcaccgccagaggatgaggccgccaaggtggctttcgggcacaaggtggaggagtggctgacgcgcacgcgcgaggaggacgctgtcacccaccctcggacaaaaaccatactgcgcgggctcgacctcttggacaaactcataccgcgtatggaacaccagcgcacggctgaggaatgggcctacgaccctgatagctggctagtgaacggcgctagcacggaacctggcctcccgggcacgcgttccaacaaactatccaccttcctagctcgtgggccggaaggcgtgttggccgacctcgaagacaggaccgacccggtctacaccgccctgatcaagagggagcgtggcaagcaccggcacataatcaatgctccatggagcttgtactgccaacagaagttttcggctgacggaatggaagatcacttgttcaaatacgtgcctagcagcctcgccaaggacttcggggtcgcccgctgggagaagtggcgacatcagctgggctccaaggtgccgctgcccaccgatcagtctggctttgacgaggtcccgggcgcggcagtgatcaagcgggtgacggagctcaaaatgtcgaagacagctctgaactgccctgtgcggatgcgcgtggctgataacctgcgccaccgcatgggcagaggctacgccgtgtacgaaggcaaaacctacccgcacacccgcgggatcatctccgggtgggagtggacgtcgaagatggataccctgatcagctacgccgaggcgctggcgctgttcgaggaagcaggggtcgacatgccggatgtggacgaccactgctaccaaggcgacgacgcgatacagttcctgcgcgggtggggcgacgtgctcaacgtggttgagcactacgcagagaggctgccggtgaatccaaccaaattcttcattgacacgaagaggaccgaatttctgcggttggtgctgacgccggagcgcaggttcggatatttggcgcgcgcagtccccagcctagtgtacgcgaacgcgtggcaagcaggatcgatcgacgaccctaacgcgctggccgaatcgtggtcgagaatatgggcgcgagggggcgatccggacgctgtcgcgaggcacatgctctcggacattgggggctacctccgtctgccccgagaagatgtgcgggactggctcttgactccgaaagctgtgggcggagctggtatgctgggagccatccccggaggaagacgctggctggccctggacagggacgtcgaagtggtggaggcttttgccaaaaatgtcaaccgtgtcaagctggagacgcttgagacactagcacaacaaatggtctggaagacagccggcgagctgctccgggcaatcccaacgcgcaaagcggaaggaagagcagtgtgtgagcacctttgtggaggattggtgctcacacacgcgctaaagaagaacgctgcaacaggtcggtactacctacgcagcgtggaccgtcgagtctactccaaattgggtttggagatgggcacgcgtcggatgacctcgggcggcagacgcccccctaacattgagtatgttggaccccggtcactgtgttgcgccgcaataagcgcgatgacacggtggcaagaagcaagggcatacgtaagacacgactactgggatagcgtgacgctcaattatcgaacctggccgcgaaaaacgtggtggcagtgggtatcggggaagctggcagaaccaagcgctgctggctggggaatggcatccgacgttagctcgtgggtcaagcgtgaattgcgtctgattgggtcctggccgggtggaaggcctagccaggagcgtatactcaatcatcaccttggcctcgagatgtttgcagacgagcatctcgctccacaattcgcccacttgaggggttagacctaaagctggcacgcctaccagctcctccccggagggaaagtaaagcgcattcggtctgtgtgctatcgtctcgtgaccccccgaggcggactttt

SEQ ID NO: 555 - DNA, 2798 bp, Unknown
  derived from dsRNAs of unknown virus
  misc_feature (2797)..(2798): n is a, c, g, t or u
agatttatgcaccttacgcgtatatcggtggtgtaaaagactaacaaagaatagggtagtacctatgagctacatacctgccgtgtcatttagattccaaccatggctacttcaaataggagattaattactatggaaccaatcaatttagactctaaaatctttagagcttggaatgattttaacaaggtatcaattaagaagattcctgatgctgctacttttcagaaattaatttcactctcaccaaaaattagaagttggtatcaagactggagctttaataattctgctttcagtcaaatgccttcttcttttaaggaacatggtgtgacacctgccaagtgggaggagattgcatctagacttcctgagataaatttagcacgtaaggaaagttcagcaaggattgaagttaaagctaaagagttttcagttatgattgaaaacgaacagatggctcttgctgaaaaacttgcaaaactggagaatgagtatgttaagatccttaagattaatattacttgtttgcctattgaggatcaacttgaaatcctttccaagcctgaggaggatagggaaaacgttgaaaagataaaattagaagcacttagaacaaagcttctcaaagatttagcagatggagactttgtcgaccctttcatttttggggacttcaaggatcttctaagttaaaacatagtgaaaatgtccaaaagaaggcttatcgtttagcgaggctttggtatcgtgagaaggattcatggaagaaccaacgttatgttggctgtgagatggatgatgtttcaattggaaatattaatgctgaaagggaaaagacttgggaacgtagaaaaccattagctgaacttttcaatatgagaccagaagattacgatctttctggtgttgttaagaagattactaactacaaaccagttaacaataatggggttccttctattgagaaggaaactactttcttgaaaagaccctttaagcacgatagaccattaagctctagtgaaaggtcacaacttccactacctatcacttcatgttgtaagtgggttggtcttactgacttcccagttggaacatggatgcaaaacttcagacaaccttacggttggtttgatggtttgtctgattcaaaacacctaaatcctctgctaaaaggtaaggaggaaagacttctgtcaaggtacacccttgtctctggttcatggcaaacaaataagagtttgcttgttgatatgggaaaaccaccagctaacaaagataatgcttccgtttatgagctacttgattattctattgataggatcgataaatttgggcttcctgttatttcttctaaactcccgaaatggtggttaagagcagtgactatgaatccagatgcaaatcctggagttttgacaaaacgtctatttggtgctaataagagggctgcctatggtaaagctattattgtggcaagtagaatttgggataaaattgtaactagtagatctgctatatgtgataattctttgtggtctgttggtggaagagctagaaaacaagacatggcgaaaggaaaaccccctgagtctcgtattattttaatgcccgaaacacctaattcaattatagcatctgttattgctcagcctattattaaagagatgaagaaggtctcgactgcaaatcctgatgttgaatgttttatgggacatgatgtcactttaggtggatggagcagaattaaagagtttactaaggaaggaactcctacgttagaattagattgggaaaaatttgactcaactatcactgaaaacgttatagtcgcttctttttgtttactaagaactgtgtttcctgaaagccgaaagattgacaaattgtttttatttgtgatgtctggtttcgtgtataaaaatattgctatcaaacaaagatttatatacagaattacacgtggtgtgccatctggctcgcctttgacttcactaattgtaacattaagcaactgggtttgcctaaattacgttctgaggaagcaaaaactgtttggtattgaaagtggagaagattataaattagcagtagctggagatgacactcttatagcttttgttaataataatacctttaaactagaagatgctaagcatgtttctgacaccttcaggaaagaagctaatttaaaagttgaacctgatgatttgaactttaatgaatggatgggtggtgaactatataacctagatgacattgagtattcgccaagcctacttaaaacaatgatttggcagggccttcctgggagaagattagatgacttagtaaaatcaatttcatgtccagaatcaaagatgatctcatattggtcagttcttgcgacattgaggggttatacgagtcttccaatcatgactccattaggtagagctttactaacttcattaggtgctttcgtttctgagaaatgtaggctccaagatggtgaaagcgattttgatgatgtttataatcctttttcccctaacacttatttaccaaaatttgaaagtattgtcgtctcaccctgcgttagtgacaagatgaatagggacccgccctatttaactaaagataagtggaacggtttgccagacactggctggaaagcggtgttgattttcaagattgacttagatttatttggtgtctccgaatagaatataattttttccttcatatataccatacatatgatatattatatattatttaatataatatatgcatgtgcatggtatatatgatnn

SEQ ID NO: 556 - DNA, 2618 bp, Unknown
  derived from dsRNAs of unknown virus
gaatgaagaatgctagaaaacacaaataatatacaaagataacggagttttaaagtagaatcaggttggtgaagcttcctagtcccttattgggatctcggaatgagtgaaattgttccctatcaggaagtaataactgaagaggaggcaaataataagttaaagcaagagttagagggccagttacgtacgttacgtacgagaagtcctgatgatcgttttcgcgcagcgatatttgaactctttgtaacgtttgatgacatatcatttaatgaatcaggtatcgcggaatcgataaccgaagcatggttagattctaacttgagcaatactccattcgatgatagatttctaaacttgctttctaatggacagctatttagagatagtctcggagacaggctcggcagtagagtagcgaccttatgtattgacttagtgtcaggtaaagtactagctaccgacataaaacagcgtgagctacgcaaacttctccaattgcagttgcgtgcgatggaaaacattggcgacttgaggcgcaataagcgtttacgcgagcaaggaggggtaaatgataaaggtcaatttcaatacctaaatctaaagggcgcacgcatgccacgtacgataactccatcagaggctaatattatggctagttacgagcaaaacgatgagtatatcatacatactaattttagtaggtatgcacgtagtgaaagattgaggacctttaatgaatcagagggtgaggtcggctcatactcacatcccgctgaggatgctagagatatcaccacaccgaaaatcataaaagtgaagattgataaaaagtacactaacccataccgtcatgctattcctaaaaagtctcacaccgcaacaaggttgacggattatggttatggatctactacagaagtacactttctggatgacgtaatgcttgctgaaatatctggcggacgttcagtccccaaaattgataaggagcagcgagaaccgaaagacggaacctatactttacagcttaggataccatcgacacagatcaaatacgtcatgacgagcaacggaattgggagcgaaaatactaccggaccaattctaacctcaacaatagtgttaagtgcgtacgtaaccccaaagataggaaaggaaaagtgcagcttaattaagtttgtgactcatggaaacgaaactttacttttgaaggacattttcgtcatgaccgtaattcctacaatgactcttaaccctcgccatgaattaatatcgaccagtttccctgtcgctgcacactttaacgacgtgggtgacaatttaagcgtgtcgatgctagagtcaagctccgactcaagaaacgtagccgacattcagaggtcatttaatgcggaattacgtgaaacagaacagtggtcaaatataaaatatgcagagctgttaagcatgtgtaatttggtgtcaaaaagaaaccacaaaggactggggaagactttacaagataaaataaggtcatccaagtttataatggtaactgaaaatggtgttgagtttgaggatgtggaggaaatccacgataaacaaccagtactattcaacatgctacatgattttggcctaagactcttgtggtatacaagtacacgtggtgtatctaatgactacaagatagtttttgaggaagtgcctgacatgtgggagaaatttttccaaacctcatgcggtccaagcatcactcattctgagaacattcgatcacccaatgaggaacacaccggagcgaaaaccattacacctgaaatacttttagttagactcgcgttatcacgtatattaaatgttggaattggtgttaggaacgagcacataccgacacggccaattgcacgcactgtcccatttcatataacaaaccaaaagagggccaatttaacgagtatcccactatgtgtactaaaggatgaactgctggtatataatctcaccggtacgttaggaaagctttttgatggagtcttgccaactgatttctgttataaagatcgtaacggcagaatgagcgagtgtagagatttgaaaacaatagtttcgatgtcacaaggtcagcgaaacgtaagatctccacaaatggcacttgatgcagctcacgtgctcttcacagtaacctcacctctaatacaattaggtgtaaatgatgatcgcaccacggtgaacccgttacgggtgatctcaccatcaggtgatgaattcgatgtcagcctaattgcagaagagatatgtagaaagctaatgtccaacgctaaaatgcggggggaaattacgaagaacgaaacagccataatgtggcatccacttttctgtatcgtcgtcaacgtgacgaagattagcactgggaggctcatatgcgatgctttggtaatgccatcaaaacgtgcgtcgtcattgtctacttcatatcataacacaaatgatgttttgagagaaatggagttcaaccatgacgtacgtgtccatttcgcaatgctctctgataacttaggttacgcaactgggctaaattcccacctccaacgcaactatgtataatttctggagccacacattctcgaaacatc

SEQ ID NO: 557 - DNA, 2616 bp, Unknown
  derived from dsRNAs of unknown virus
gaatgaagaatgctagaatataaaaaaataatatacaaagataacggagacaaaaagtatctttagttggtgaaactccaccgttcccttttgggatttcgtgatgagtgagattgtaccctacgatgagacaatcactgaagaagaagctaacaacaaactgaagcaggaactagaggccttactcccaaatctacgtaccagaagctttgatgatctatttcgtgctgcggtatttgaacttttcactgtatttgatgacatttccctagacacagatagtatctctgactcaataagaaatgcgtggtcagatctgaatttgagtaattcaccacttctagacagattcactgatctatttgatggcgggcagatctttagagatagtttgggtgataacattggcagcagagtggcaactcattgtattcatgtacctaccggtactagacatgctactgacattaaacaacgtgaattacggaaacttctgcaattgcaactgagagctactgaaaacattaatgaccttcgccgaaacaaacggctacgcgagcaaggaggtgttaatgataaaggtcaatttcaatacctaactttggaaggggcccgaatgccaagatacatcactccatcggaggcaaaccgcatgaccagctatgatgacaatagtgagtatttcatgcataccaacttcagtagatacgaacgtaaagaacgtatgaggaaattcacagatgtgccaggtgaagttggttcatactcatactcggcagatgaagcacgtgattttacaacgccaaagagcataagagttaaatttgcgaagtcggaatcacagccgtttacccttcctattcttaagggttcacatgcagcttcgagactgacggattatggatatggtgataccgttgaagttcacttcttggatgaggtgatgattgctgagatctcaggcgggcgtacggtgccaaatataaagaaagaacagcgaaatccaggaaaaggaagctacactttacaattcaagataccgaatgccagtgtgaaatatgtgatgaagaatgcaagtgctggtcatggtaacagcagctcactaattctgacttcaaaacttgtactaagtgcatacgttacacctgctatgaagaagaagtgtagtttggtgaaatttataaacgagagtgaggaaccattagaattgcataacgcgttcataatgaccgtaatgcccttaatgacattgaaaccgcaacacgaattaaaatcaaccagcttcccagtagctgcttcttttaatgacgtcggtagcagtttaagcgtcttaatgctaaagtcaagttctgatgcacgtaattcactggagcttgcaaagtcatttaacaaggagttaagggagaccgagcaatggtctaacattaaatacacagagctactaagcatgtgcaaccttgtgtttaaaaagaacgttaaaaatcttggcaaaacattgcaggataaaatacgatcatcgaagtttataatggtaacagagaatggtgttgaattcgaggatgtagaaaagattcgcgatcaacatcccatagttttcaaaatactgaaacgctttggcttaaacttactatggtatcaaagcacacgcacgttaactgaagaccgtaaacctgctttcgaggatatatacccaaaatgggaagaattcttcatatcatcttgcggtccaagtatcactcactccgaaaacattcgatcacctaacgaggaacacattggagcgaaaaccataaaaccagagatacttttagttaggctcgcgttatcacgtatattaaatgttggaattggaattagaaatgaacatagacctacgaacccaaatgctcgtacagtaccatttcatataacgaaccaaaagagagccaacctttcaagtatacccttgtgtgtacttaaagatgagctattagtatataatctaactggctcgttaggcaagctttttgacggcgtgttcccaaccgacttctgctatgaagatcgacaaggtaacgtgggcgaatgcaggaatttaaggacaatagtttcaaattcccgtcatttacgaggagttaaatcaccgcaaatggcgcttaacgcagctcacgtcttattttccgtaacgtcgccattgattaaactgggtgtggatgatgacaccagcagcgttaaccctttacgtgtaatatctccctcaggtgatgaattcgatgtaagcctaattgctgaggaaacatgcaggaaacttctatcgagcgtggaaatgagaggcatggtcacaaaagatgagactgctattgtttggcacccgattttctgcatagtcgtcaacgtgactaagataagtaacggtagacttgtatgtgacgtacttgtaatgccatcaaaacgcgcttcgtccttatctacgtcgtaccataacactaatgacgtgctacgagagatggagtttaatcatgatgtgcgtgtccatttcgcaatgctaaacgataacctaggctatgctacaggtttgaatgcccatctccaaaacaactatttataacttccagatccacacattctcgaaacatc

SEQ ID NO: 558 - DNA, 2089 bp, Unknown
  derived from dsRNAs of unknown virus
gtataaaacatatattttaaacactattaaattagttttatcaaaattttctgttcgaaacttgcatgttagaccagaaatccatattctgttgctagtgtcgtccaagatacactaagtcaagtcactcaacattacatatattaacataggaattaaataaactatggaacgaaactcattagatgatatttcatcaatgcgaggtggattcatgatcaaccctccgggtacatctagaatcccaagaacaagaattggaacaaacacaggcctaccaccagctcaggaactaccaactaaagaaggtaaatctgtccctgagtcggatcttagaactaaagcgtcttctaagactcaaacaaaaacaaaaggttttaaacaacctacggctagagccacgaaaacagctcaaacaaagagctcaccaagtcgacaaaaatcaggacgttcgcaatcgcgtgccactactgttatgtcggccggtagatcgtgggttggcggttacggcggtaaacctccaggtagtcccgaagaatccggacaaccaggagatagttttcctacaggtgaagtagaatacctaggtggaccacgagttactactcaaacctcaaagttcgacggtatatctgaaatcgatcaactagaccagaccgcaggttcatggactggagatccttctcaagtaagaacactttatcaatcattcaatttccaaccatatccgaactacggcggtgcaatcgccggcatgaagagttcaggtgcaacaacgtttgcaacagcctcaactactcaagacgagatatttttggatacctttggtgctattcaacaggaatacagtgaaaattacaatgctaacacagtatttgaacaaaatttcaaaccagtgtatttctactattatcaatttgatgttaatagattacatgcagaatatgtttgcttattacaaagagcagcatactatcaaagtaccggcactgagtatactgagaatgcttgtgctgaaaagatagcaaatgtattgaatacaacaaatttctatcctattcgtaataaaatggcgcgagctttaaaacgccaatttattgacagagagatgcgagacaagcattacgaaatctttcagactaatcgtttaactccacacgaaacaggtggtacaatctttaatgttaccgatgcaatggcaacattattacagaatttatcaaacgccgcagatttagcaacagcgcaaaatgtggttgcaacttatatagctcaactggatacaatgtgtgactacttactttatggtcgtcctattcagactgatacttcagtgagtccgtcaaaaacaattccagactacatgatacctaaacgtgagttttcgggaacattatacaatttatatactggttccgaccctgatactatttactcaactgttcgtagaaacgctatgagtgcgattcttgatcgagtttctggttcacgaggatcatttgactatgttaaattaaattaccaagctcgcggtaattcaatgtcattatacgactcagctttctgtgatcgttataacaatactccaaatcgaaatggaagtacgttctaccctacaatgttgaaaggtagtactactgtgtcaaaggcggctctttcagcatcgccgtactactgttctgaacgtagtgcagacaaccaagattgtgatactgtattccacatgttattaatgtttaatggcgaatccccattatactattcaaactcgagaatcacaagtttcacaacaagagagtattttatttaccgaggaagaaattctttaattggagatgaaaacattgacttagcttacacagctaaaggaaacatcacccaagtaggtagtaatgcatttccaccgattcaagataactatgttactaaaacctatttcgatggtagtaacatttatggtttctctgctcctgacggagacagttcaccattatacttcgtaacttacggacgagttatcgagaaattcaaacaaaagtatatggttaataaataactacatcgcctgaaaacatcttgttttcaggtc

SEQ ID NO: 559 - DNA, 2455 bp, Unknown
  derived from dsRNAs of unknown virus
gggcttgtccggtgtgctacaccggcaatgaaggcatacttgataaaagtagcaagacatgtgtcactgtatctcatcgtgacaagtccaatagccttaccaaaatattgaaaatgaacaacgttaaccaacatagattaattaatagaactcggaagtttgttaaaactaacgaggcactaataattaaacttagtagattatcattgaatccatcttcacaataccttggtgagggtcccggtatatatatatacacagcaaagtttatcaaactttactcccataatgggttggattacacacttaaatattttaagaatgcaagacaagctgtatataaatatactagtggcgactcgatcaattctatagatcatgtctcattgacaaaagatggaataccggtctttttacaagactggattcctttattaagatccggagaccggactgcaatacaagtagtattgagcatcctaagtataggaaggctgtttactagtgtaggtagtctagaaaccgagacgataacaaatccatattctggaatagaaacaacggaagttatttctgaccaggatatagagtcatttgttaatgagtataatttaagaattggtgagattgaaagtcctgagttttatttgagatcctcaactggtcctacagggccagctatggcttctatttgtcaagagggattaaacttgcctgaatggctatataccattctgactagaatattacctcaaaaccaaattagagttttagatcaaataagaagtgatcctatgattaatactccggatctgcaagaactttgtaaagattctaatataattagaaaaattacagttgttgcagataaggagggtaagaatagggtcattgcgattctcgattattggtcgcaacttgcactaaagccccttcataagaacctaatggatcttttaaagaactttagtcaagatgcaacctatgatcaagatggaatagtaagtaaactccgtaaggaggatacctattactccctcgatttaagttcggctacagataggcttccccttgtattgcagggaaggctattgaaagctattcttaaagacgaatctaaggcaaatgattacatatcactcctagttgacgagcctttcaccacacgagataacaaagttatcaaatatagtgttggccaaccaatgggagcttatggatcgtgagcccttcttgcactaactcatcacttgattgtatataaaagtttgatagaatcatcaaccaaaatggatggtggggcttcgaacaattatatactactgggtgatgacctagtgatttcaggacaatcaacttcaagtgcgtataaacgcatagttcaagatctaggaatggaaataaatcttacaaagacactagaaagtaaaacttcttttgaatttgcaaagagatattatatctcaggaattgaacactctccaatgccaattgggcaaataaaacatgcaacaactcagtattgagatattgtaggtttcattgaccagtgtcaagggagaggatgaagtttctccgctctcagtgctagagaaacactgtgttcaattatatttaaagatttaccagcaagaaaacgaatttacaagactaatcttgttcataagttttatcactgtgttaatccttataaagataattggaatgaagagtttgatataaaacttgacaagtatatagatcctagtgtatttaatcttggttgtcatgcgacaaccgattttaaagttgaatttattcttcagcattatttacatgtaactatggaatttatccataaaaacattgtaaatcaggctaaatcatataattcaatagctagatctaagtactttcaagcttataacgataaacacgatgaataccatccaatcgtaacaatcctgtgacacgtcgcagaaggattacggaatgttgagtataaagtgtcatcagaccctgttgctgaaactgagaaatattataagatgaaggtaagtcttaaggactttacactccttcctaatgatatttcgaaagttttaaacaactcgggtcactccaaaactcttcgagcgcgagcctatattagtaatcatctacgagatttccttgtagactttgaggctggtagactttcagctatgagaggtgaacatgaaatataattgttaccttaaataaatgaaattttatcaaccaataagtcttatagtacagtcttctatatgattactaatagagatatgctggaaacaaaactggtaacagtttgaaatcagcgagttgagcttgcgaggaataatattcttagcaaccaatttctcaatctcacaaggttgtgatcatgaccaaatatgatctgctagtttaaatactatgcctccttaggcctgttagaaacaggcacaagccc

SEQ ID NO: 560 - DNA, 2142 bp, Unknown
  derived from dsRNAs of unknown virus
gggggagaccgtccctaaagacggtctcttccttgcctcaatcatcgacttccgtgagatggcacagcgaaagctggagagcaacatactgaattctcagtatttaccggaattccaaattcatgatgaagttaaaattaaacgaaaatatcgtagtgatacttctgtctaaagataacattcaaaagaagatggttacggattgttggctaaagtataaaacaaactttatcgcgtctcgaaagaaacacggttcgaattacactctgaagctatataaagattcatacaagtttcttgtagatcttcatatgggcttccacccagttcccattagttatgctaaaattgatagaaacggtttacctaaagtattatggccattaaggccattactaaaggataaatcgatatctaacattagattgacaatgtgcatagcacgtgtctttcaacttattagacttcctatcgatttagatacatctaagatcaccgatcctggtaacatacttccgaacaactatttaaatagtttcgctgagtattgccaaggatggttttcgaggattaatctcagtaatattaaaacccaaagatttagtgctcatagttcgatgaagtccggacctaacggtcaggctctcgtctatgctcactacgatctaggggctttaattagaacaccagacctcctcaaatcgattgttaaactcaataaattactaggtaattattgggttaatcgaatgatggaggcaaatgttctatccaatcacgaagagatcccatcaatccattctcgtctcgggtttagtcccgaaggtggtggaaagacaaggatctttgcaattggagattactggagccagatggcattaagaccaattcatgatactctaatgagtatccttaggaatctagataccgatggaacttacgatcaggaaaaggctttcgcccgattactgattaagtccaaaggtaaagaaacctattgttttgatctttcaggagcaagtgatcgtatacctttaaaggtacaaacaatcatgatgtctaagctttttagccaggacatcgctgacgcctggtcatctgttatagctaatagagagttccaccataaatacggagaacccattaaatggaaagtaggtcagccgttaggcttactatcttcctggggttctttcgcattatggcatcatatcttaatagaatactgtgctcacaaaatcggaataaaccggtttagagattactgtgttctaggagatgatgtagttatatggaactctgctgttgccatccaatatcagaaacagatgaagtttttgggaattcccattaaccaatctaaatctgttattggagatttacaacatagtcaaatcgagtttgccaaaaggcacgctcgtgacggtgttgaaatctcaggaatttcttataacctcttgaataaggacagtctacgtaacgtagacgaacttatttgtgagataaataagaagtcaatgatggatgacatggaaaatcattctcgtattttggtccgacatcctaattctaggattgaagacttacttaatactatcataactctaagacttctgcgtggcccaatccctttaaaggaaaggttaccatgcctcgaagtcgaccccactgaaatttacaaacttgtaaagatcagaagaggtgagaaaatgatggagaaagtaatggatctcgatagcttactcggaaaatcaattccgattgaaaagctattcgagaaacacgaagtgcaatatgattccacggcactggggctcaatggattgtcccactcagaaagtttgcaccccttgatttgggttatcaatcacctaggtgaaagattagccaaactcttggatcaaatttggtcaggagaacctgacgcaataaatgatgtagagtacttaccaactattccgaatagagaattcttcgcaaatagcaaatctgctaaacacgaatatttctcatccatcgtaattgatagttatcttgagcttaaaattaaagctcaagaagctcaggggggttaaaccttgagtaggagtatcatgagattcggccaatggccgcgagaccacctgtaaggtggtctccccc

SEQ ID NO: 561 - DNA, 2111 bp, Unknown
  derived from dsRNAs of unknown virus
gaatatagaactcatacaacttaaaaactgaacaaaatttaaataatcataaaattatgactgtgcttgaagatacgaagcgctatgcgattgatatcgctgaagcatcactaaacgcatttcaaaaacaagctcgtggtactattcaagcgccagcgaatgctgagaacgtcaggttattcaccgctaaaggtggatctgctgtaaccctggcgtcaacgactgattcagcttgcgtcatctttgatcctgaagcaacgctgcgtaatggccagctcaatgtggtggtgtacgaacgcgacgcgggcgtggtgaccgcggtgcaatcagtaaaccttggaaggccttcggaggaatttctatccgcgggagtgctgtcctctggcctgaaagtgttcaactcctctggtgttgacgtgattggtggcactcaaagtgctgctgtgcttagttcagtgccaagggatgtgtcaacaatgacctcaacggacctatcgaacttctgccccaatcatgagcgtgacttagccagtggtgtggtgtcccgtgaggattccaccctaactctggcacttacaagccactacggaacgaaaatgtgccttgcgcgtcaaaacacacaaggcaacctcgttcaacgagtgtgggacgacggcattggtgctagaaggaccaccagtggacaatcgctgggtcccagcgctgtaacggtctttgatgcactcacaggtacggcccgttccgatgcgcaaattatcgcaggactcgccagcgatggttcgactagcatggctggcaccaatcttattgatactgctaacctggatgctgccaacaacccgctaaccctggcaacgttctccgcaagcttcgaaggaactttctcctttgttgggcccaatacgggtgatactaacttcactatggatatgactgcactggcacttgatgctgcaggcgtagtgattactagccttgagatgcgagatgtcaagccaattaccagtggtgagaacttcattattagggcgagtggttcacttacaagtgccacacttcctattcatcgcgtgatatttgcggtccgagatgaatccactacgcttagtaaccttgactttagcccagcggactcttcgactaaaatcactgcgttcgaggaaacttccgacctccccgctcgtgccgttcacgctacagttctagaggggctgaatgcttcggctacgttgaaccttggatccttcgccgtgttgacgggagtcccagattcaactaacgtttttatctctcaatcttcatccgatgatacggtatatgatgataacgcggtgaagttattcctgcgatccattactaaggtgatgcctcgagcattcactattgacggtcattcctcattcaccagggagttaactgcgatgtacggctctgaagaaacgacagtggcattccaagcaatgtcgttcgcgaagactgctgatcgcgttaaaaagctggccaagattgcgaagtctgctggcagagatatggcgagagttctagccgagctggagcccatgatggacgtcgcaggcgcctctatgtcaatgcttccaggacctgcgggaatggcggggactgcaatggcttctggagcgaatttgtcgagacgcatgcgaggtatgtgaaggtcatgccattttccaagcgtactgtatattaatggggagttactaccaggaaggatacatgagctaatactaactaaccatccacttgataggaattatcgactaaaagatggtattctgatggactcaaatctaaaggattctagtgctacaatacggaaaatgcttaaggactttggcgtggattatgtctcactagcacgtgacaatattgtggaagggcgttcttgggaaatggctgtgtcacaagcgctgttaaactatgatggcgtatactcaggtacattggagtcgtataacgacacaaaggttgtgtatggaccagtgcccggattagatgttaaacgaaaaatgattaatagtaaattaataaccagtaaggagttaaaagttgtgttgttttcccgataacgcgactacatgagttcttgaaacatc

SEQ ID NO: 562 - DNA, 2056 bp, Unknown
  derived from dsRNAs of unknown virus
tgaataaataataggcaacaatttatgtaatggaatggaatatgaataaataaaacaacaacattttaatatagatgaagctaacactgatttaatgatacaagatataataaatagaaatgacacaaattatttaataaggtgtgaaataaatgattaaaatgcattactggattggtgtgaaatgatacaaataactctgataagatcaggaggttattataaacatgacgaaaaataaatataatcaattgagtataatttcaaaaattaatggagaggttacaaagacaatgaccacttcaattatgagttaaagcaaaacaataaaaatctagttatacaaaataattaataataaccataaatagatcaaaaccaacaaatagaagtgtatgcaatgtatgaatatgaattaatggaagtaaacaaaataagtactgaattaatgacaaataataaagatttttatatagattatatacaaccaataaatgatagattagaaaaacagtaaattgtagatttaacaagattaaatagtattgacactataaatttatggagttcattagatttaacaggaaatataactaaatatggaccattaaatgatattagaataagatcaaaagaacaacctaatgaagttattgaataaataaaaacaacattaacaagataccctgagtaatcttacccaatattaacaaagagatgttataatgaattaaacacaataacaggaagattagggtcaaaactagtgtttagaaaagtaataccagactaaagatatgaaatgcataaatttataaatgcttatttagatcaaaatgcaaatattaaaatataaaaattcaaataataaaaattaacatttaataaataaggtattatagaatggttaaatagccatccagcaccctgcgagaaattgaaacaaatttaaagaaaattggcatttgaattagaagttagaccactaagtgatgtaaaaatacatttaaaattagaatcactgttaaaaacaaaacctttaacacattgggatgaataacaagccagatcaataatatggcaagaatatgcaatagcagcaatatacagcccaatattcacttaagcaaaagacagattaaaataaataatgtatagcaaaatattatatactgatggtttaacaccacaataaatatcaacatttgtaagaaattttaaaaaatctggtgcttttatagaaaatgatttagaaaaataagataggtaaacagacaaatatttaatagaaatggaaatgttgatttacatagaaatattaggtgtttcagaagacataataaaatcttggaaaaatgtgcattttgattggagatataaatcaaaatattcaaaaggtagatttagtgaaatgagattaactggataagcaacaacttcattaggtaatgttatagtgaatatgttaattttatcagaatttatactaacaaacaaagaaaacataaattatgttttgtttttaggtgatgattcaataatagcattacacaatgaccaagaaataccaaatatggaaaaatatattaaagaaaattataatatgcaatctaaattatataaacataaaggtgttgcaactttctgttaaatgttagtttataataattaagatagtgatgaactaggacctgacattataagactaagaaatagatttgaagtaactaatggtgcacatgaagcaaatgatataaatattaatatgagatcaatgtcatatgcctgtgttataggagaaactgtagaaataaattaattaattcaaagtaaaaaatggcctatagaagtttaaaattggtatcaattcaatgtatgtatgatgtaatgcgctaacaaatacaattgtgaattagaataagttatgtacaattataacttattaattgacatgatggaaaaataataaacttactaacacaattttctccactggagtcatggaaaacgtgtgtgagaaaaaatattagttggtcaaataaaattgtttggcccc

SEQ ID NO: 563 - DNA, 1906 bp, Unknown
  derived from dsRNAs of unknown virus
gacaaatcgttttacttatggtaatggtaatgcgggatttggtttctacagttacacttacacccctaatatctgggcgatgcgtaatgatacctaccgacctggtggttctacaggtactcaactgactaacattgtcggtactaaccgatgtgaagcagttccagttcttggaatgaacgttaattccgttcaagaggcaactgtctcagcactagattatttacttagtattggtcaagtagggtctaaagccccactttcttctgatattgatgacgagaaacctttaaaaggtcagacgtcgaggtagaagacgcaaataattgaatttaaattgattatgaacaaaagaattacatcccttcctttcttagatgttattaatgaacttaaccttggtaataacacttatgctaaagagaagctttctaatcttttgaccagaacaactgttggtagcaaggatattcttgtctctcctattggcaaatatggtccggataagcttttaagtgaatggcgttccatatttgaggaagcagtaaattcaggtaaggtaagtaatgaagtacttattggcatagaagatgcacaagctgataaatttagtccacgttctattgctttaccttggactaaacgtaaagctaatgttgatcagtattttatcgaaacaaacatagattactcaagtctagactgttcaactagtgcgagtgagagtttgagacctcttaactacattaatgcttccaagtttataaagaaatcaactagtgctggtttgcctagtatgagaaagaaaggtgaagtactcgaagaaaccgttaaagacattgagtactacttagatcgtgaagatcctgctgttctttatactcgaactcaagaaagcgcgaaaactagagacgtcttcggtgttcctcttgctgacgtattaaacgagatgcgttattatcgccctattcttgagttccagaagaaattaatatggcgttctgctttatcaggacccgaccgagttgctaagcatctaactgaaattattgaacgagccattagtgaaggtttgacactgatttcaatcgatttctccgcttacgacactaccataaaacaaggactacagttcaaagttggacaatattataagtcactatttcaaaagagttatcactccgaaatagataatattataagacggaagagtaccataggacttgtcacaccagatggcgttatgactggacctcatggcgaaccgtccggatctgcattcacaaatgaagatgatagtttagctcaacactgtatagcaatgtcatccaatgcaatcatagaagatcttttagatattcaaggtgatgatggcgtttatgccgttaaaccagagactgttaattcactctacaatactttcaagaagtatggtttaaatgtaaatgttgataaatcgtttgaaagtccgaactatctcgtatatctgcagaatctgtatcatcccgattttaagagggacggtgtaatcggtggagtctatcctactttcagagctttgaataggatagtttatcaagagcgatgggctaactttgaggattacggcataaaaggtaaagattattatgccattagaacacttagtattctagaaaattgtaagaatcatcctctgtttgaggagttagtcaaatttatcctttctaaggacaaatacaacctagaagtttcttctcgtggtgtcaatgaatatgttaagttcatgattgacacagagggcacagaaggactgataattaaccagtacggtgacgacctttcgggcattcgaaattggcagtcattccgtcttgttaggtctttatcaggaagctagtactctgggagttgtcgactccccccc

SEQ ID NO: 564 - DNA, 2006 bp, Unknown
  derived from dsRNAs of unknown virus
gtaaagaaacttttcttttccccgacgacatacgggacctctgaaccttccaagttcggaaacaagtgtcagtattaacctaataatatttaactaatgtatccattacattcaggttacagacgtaaccgaacgattttatcgttagtacctcaaataggaggtaaacgcaatcccaattccttacaaccaggaactggagcaccactgagtcaaccgggcgttgcacccagaccagtaggatcacccaagcaatttgttgaagtatccactaccggacaagctaaaacagttgcagaatcacaaccgatgacagccacttcgctggaatcaaaccgcaaaattaacaaaacaaaacgcatgccatctacaaaacgtggaaagaagaaagaggaaaaagacttcatgtacgtccctcgaggtggacgacctaaaccaccggagaaacccggtttacagtatacaactaaggatcgtgtccctagcggtgccatcccttacagagatggaccaccaactttcacgcaatcttttccattaggaaagattggagaactaccgaataagaaacaaactacagtaggatgggacctttcagctcaaaaactgaataacattcgctgctcaatccaagtagtcagcgctgccttctttggccaagtgccatcattctctacaggccctggtaaattagataataatttagacgatacacaaggacgtatcttcggcacattttataatcagattagagctatttatcaagatagatacaatctgaacacacagtttgtcaagacattcacagcccaaaatattttcacgtacttccatgatgtgcacgcacttcatgttgaatttgtttgctacttacaactagcagcatattacaagaacgttgattcagggatggagaatattctcctagataacatcggcatcgttcttaacacagatgtctttaccgttattcgaaacgacatgtcacgtgcgttacgtttttcttacttaccacagaaagtaattgactctaactacgagatgttccaaacttatagaatgggagaacaagttactgcaccgtcatttagatatgtaacacctgcgatgatgaatttcatgaaaaccgctagtgtagcagtagaccaagccgcttttgatgcagctgtgacaacatacaaaacccatgtctctgggctagtaaatcacgttgttaccgggcgacctaacgcaacttctgttgacccaggtatcttaagactgtctagatctaccactggtgctggtgtgactactactaattattatcctatgtttgacataggtaaaggtgctttaagccaagaagatatcggattccttaacagtgtgtttgcacgagtatcagcctctacaggcttagcttcgctaaacaaccaaaaagaaggtaattctcaatctcaccatgacgttgacatgtgtgacgcctttaataatcatttgttagctgtgagtaccctttctgtgttcccaagtgtggttagtggagtttcgacccatgtatcacctgacggatacaattctgtagtttacgcgtcagagagaaagtctgaggacgttctcttcaaagcaactcaattccaagctgagaaattcactggttcaggtcatctgctgtatcgcacagatccggctggcatgaatcgttggacacgcgtgtatttagatgaagtagatcgtaatactaacctagagcaatcgtcagatctgacattccaggttaagaactcttgggctcaagtcggtaacgatacacagcctcttgtacaagacaattacgtaacaaaagtctttagaaatgaagcgaataccagttacctttcggtaaataatgtagactcaacgtctgcggcaaagtggttcatcactatgagtgaccttatggagaagcaatacgattgtggtattgacttattaatgtaatgtcattggttaattttctagacctagtctagaaggttaacccc

SEQ ID NO: 565 - DNA, 2042 bp, Unknown
  derived from dsRNAs of unknown virus
gaatattgaaaacactataattttgatacgatggatgaaattaaaaaagatactctacactatgcgagaactgtggccaaagcctgtgtgaacccgttttcttcaggtttacgtggctcattacaagccccgggatacaacaagagagtcagactctatactgcgccaggtagtcaatcagtcaccatggctgcaaacaccacttcagctgtagtaatttttgaccctgaagccagtttacgtgctggtcaaatgacagttcaagtaattgagcgtacatcagcaaatgccattaatgcatctacatcaattaatgttggtagagcaagtactgattttacatcagcaggtgtagtatcatctggtttaactgtgcaaaatacatcaggacaagataccatttcaggtttccaaacagcatgcgttttaagttcagtaccagaagatctcaatcaaattagttcaactgatttattgaatgctacatctgatcgtgaaagagatgcagcacaaattgtatgtaaagaagatgcaactacaaccgtatcatttactgaacatttaggtgaaaaacgtgcattattacgtgcaggcagattgggcaatattgttagacgtacattgaatgataatgtatctcaatttaccaataccgctggtggtgaaattagaggttttggtagacaaggtggtgatcatactttagagatatacgcaaacgctgcagctgttttagctgaaacagattttacgaaacatcttttcagatctgcagataatccaactgatatccattcattaggtacttatgctgttgaaggttcattccgcatgtcaagtgaaaacgtagcagctgattctttacgtataatcagtttcatcgctgttgatgccgctaacaatttactgcaagaaaaagttgttaatgccgtacaaggtgcaagttctcaagcattatcagataacattgcataccactttgatttacaatctaccactttaccaattgctaacgttattattagcgtacgtcaaggtaatctccaagctaaagctatggaatgtactattacttcaattgaagaagtagccgatattccagatcgagctgtgcaagtatgtgtaattgaaggtattaacgctggtgcaaccattacatgtaacgctggcgctgtactatccggtgtaccagattctgaaaatgcattaattagtggcctatctagccaagaattcgtatacgacatgaacttagttaaattattcattaatgaattagcttataacttccagcacgcattcactggacgtggatatgatatgactgagaagcaaacagaagaattaacatctcgtcctgaaatggaaatggcattattcgcaatgtcttttggaaaaatcggtagagcattcaaacaagtagctaaagctgcaccaaaagccagaaaagctatatcacaaggtgtaagtaaagcactaccaatagttgatgtcgccgctccattgttaatatccacaggaaacccagccgccatgggattaggagcaggaatgatgaccgcatctatggcagctaaagatatgaagaaattgggagtattagaagcatcataccacgaatgagggcgttgccaattcccaacgatatccatgataaatgatattgctcatccaggaaaattgattgaaatacaaagtatacaatcgaattatccaagtggtgatgataatattaccagttatagtccaatgatgaaaaacatatataaaaagatgatgagtaggccaaatgtgccaacaaatcatactattcatggaagatcatgggaaatggctggtatcatgtcattagctggctattcaggtatatatagtggtgttgttgaagccgtgcattatggcaataataacattactatatattttggtccagttaaacatatttatgaaaagagaaaactatataaaaatttacaaacatcaaatgaaattataaagataacattattccccagtaatgtttgaagttagcatgaaacgtc

SEQ ID NO: 566 - DNA, 2008 bp, Unknown
  derived from dsRNAs of unknown virus
gaatataaaacctattctcgtacttaagtacaattcgaagatataaatttgcactatgagctctattgaacaaactaaggcgtacgccgtcgcggtagcggaggcaagtctaggctcgtttaccaagcaagcgaggggcgatctcgaggcgccgaacggtgatgagaacgtccgtctgtacaccgcaaagggtggttccgctgtgaccttagcctctgatacaacctcagctgctgtggtctttgatccagaatcgtctctacgaaacggtcagatgaatgtagtcgtctacgaacgtaatgcttccaacgcggtggctgcggtgcagactgtgagtcttggtcgttcaactaatgaattcctttccgcaggaattctcagctcaggcctgaaagttttcaactcttccggcgttgatgttattggcgggacccaaactgctgctgtccttaccgcagtgcccagggacatttcaactatcactacaactgatgtcgcaaacttctgctcaaaccacgaacgtgacctcgtgtcaggcgtcgtttctcgtgaagattccacgatgaccatgtgtatgactgatcactttggtaagaaaatgagcctatcgcgatcaaacaccctaggcaacgttgtcgaacgttcatgggattcgtccattggcacacgcttgactacagaaggtgagaaccttatgaaagttggatcgcgtactatggtggccacggcttctggagcgactaacgccgaaatcctagcgaatgaaaacaggcgccttattgatacgaacttcctatccgcagggaacaacccattgacgctggcaacgtataacgcaacggttgaggccaggatcgtcatgaatgatccaggctcagcggtcgcccaatttaagatcaacgttagggcgctgggcgtcgatgccgcaggtactgttgtggcagaggttaacttgaccgacattctaacgactgcagcgtctagcgtatacacgttctctgctgcaacgacactgaccagcgccaccacaccaattcatcgtgtgattcttggtttggtcagcacgtccagtgacgtaactgatacccttcgtgcggcggactcctcagcggtggtcaaggcttttgaggaaacggctgacatcccggcccgtcccatccacgtttgcgttttcgagggcctaaacgcaagcgctacgctcaacatcaacagcactgctgtaatgacgggagttccggactctactaatgtattcatctcatctgcgggctccgtctcaagggtggtgtacgatacaaaccttgttgagatgttcttgaggtcagtctccagagtcctgccgcgtgcccatacaattacgggccatggcgcaatggaaaaagccgtaatggctgtattcggaagtgaagatattaaattgtcgttccaagcgatgtctttcggcgacgttattaagaaactatccggtgcaggaaagtttgcaaaagcgaccattagagatgtttctgatatcgcaaaggaggttgagcctatcctttcggccgggatggccattggacgaatgatgatctagggcacatgccattttccaagtgtcatcgcatttggtgatacgctgctaccagggcgaatacactctgtaaccgttagtaacttccctcttaagcgccaatacattgtgtataagggcttaaatattgatcgcaatctcaaggattttggagataatattttagacctgatgcagaagaaaggagtaaattacatatcacttggaagggataacgtagtggaaggtagatcttgggaaatggcggcagctcatgcagcttatggtgctaagggtctatacagtggaacagtggaatcataccaagataataaagttaaatttggcgctgtgccaggactgaggcaaaaagaaaaactatcaaaagaattgaaaacagtatacgacataccagagctatgatttcccgttatagtaatgtgtggtttttgaaacatc

SEQ ID NO: 567 - DNA, 1996 bp, Unknown
  derived from dsRNAs of unknown virus
agaaaaaaatttttctatagattttatatatgaatacatatcttttgatataggacccataacaattaaccttgaagaatattcgtgggtaaaaataaaactaattcgcacttccgttacctacataagaggtccggtttaacaagggctcagtcaaatgagctaaaaagcgaacagactattatggtcgagggtttacctgtcggaactgaagaagttaaagagctaaccacagttaaaggttctagactaaccatagttcccaccaacgattatttcggtgcaaatccgtctctattaccttactatatttacgataaagagtctttagaaagactacgtatgcacgtaagtagggttttaaggggttcttctgttgattataaatctccttttgtattcctcatcaataaagtaataggtactagtgaggatgacatgaacaaaagagaacctataatagaattctttcgagaatttgttcagaggagtccaaccattgttaatagtcactctttgttaaaaagagagttttctgaacttaaaaaaactggtactacttctatctctctaccctggaatttcgtgactgaagatgggcgaggtaagaagatcaatgccatgcaatactattctgtaaaggaaacaaatatagatctcagttcactccaaatagctattaatcggataaaagataagctttccactagtgtgcctttgcagagaatcactcttaaggaagctttaaatagatctgataaaactactaattgggggctccccttctggctaaaaggcaacgaagaacatgatggcaaacgtgttgcagatcatcattatgatattgctgccttactagagtcaaggaagctacctttctttaaagcactttgtgtactggtagaaagagttcagcctaacggtactgatgaaccaaaacaaagagcggcgatggctttccctcattacataacgctaatagagagtacgtttttagtccctcttcttaaccacctccggaaatttgagggattcgaggagtatcgtggaagagatggagcaaacaaaaaaatcaccttaatgcttagaagagctaaagaggcgttgcttattttgggatttgacggtgaatctttcgatactaacataattagaaagctattagaaggtgcttacgacatcttagcttctctatttcctgaagacgatcgttggttgattgaagaacttatgcttcaaaatattgaagctgattggttaacacctgacggcgtttatacgggtcgtgttgaaggcatgtcttctggttgttgtttaactaatattatcgatactttggtccagtacatccttatagagtattgtgctgaaagacatggtttaagtgacgaagaaaaggatcagattctgaaaattatgaatggtgatgatggaaattggcaaattcctaatcttaataaaacagatatggttacttattgtggagaactcggtatgccaattaacttctcaaaggccctagaagaaactgaatttactgagttttgtcaacgttattacgaagattctccaaattatatcgatcataatggagtatgtaaagacacccgctctatttgtagaacggttaactctattctctcattcgagagaaaacctagtccagactttaagagtggattttatagtttaagagttattggacaaacagaagaatgtgctaataatcctatgtttgaagagtttattgagttattagtcctaagtgatgaagacaatggattaggaacaaaatattctggtggaacctccaatttcatcagatcactttcaagaagtggtttcggagcatttgaaaatttagcgttaatggaaaaggccaacagttacgaaaaggaaaaggctgggaatctagacaataagattatttctcttagagtggttgaacttttagacaagactgggaggtagataagagaggacctagcccctctct

SEQ ID NO: 568 - DNA, 2010 bp, Unknown
  derived from dsRNAs of unknown virus
gaatattatagtcttatctatgtcatatcatgaatattaatttctattcaacgtacagtgttggtgttaaaacacgactacttggaagaaaattacttcgaactagagcacgcgcggcattaggttcatttgtaattggcaatgacaaaacgaatattgatccgaacgcgctgctactacgaaaggatagtgcacgtatatttatagtagacgcaaatgactttaaagatctaatgcgtagcatgaaatatagcgcggagaaagctattgcctattatgaagcggtaacccaaataccgcatacagttaggaatttatatgcttataccaacaagaagcataagcctccatccagtggatcatcaggtatacggcatatgccaaaattaacttggttttctaacacatgggataaacactcgtgggttcgtaacatgacaaaagaggatggtggatacccatgtttctggaccaaggaccatagtgcaatcacggacccattcagtaaggcatggaagctatatgacactaaattccctgataggggatggaggataacttatgacgtatacaccgatatagattcggtatttgctgagttaacgagtttcattgaaatgcatcaggaagaggaagaacttcacgtctggatacaaggctcgttaaatggttcagatccttcaatggtgataactgatttaaagaaactagtttccggattaaccttaaactcttcgcatgtaagtgaggatgttaaagtgatcctgatgccctcaggttcaggaaaaacgttttactcaaaaatgtttgagcatgtgatagatatcgatgacatatacaatggggcaacttcagtgcaaaaacgtaaaagaaaagaaacaatggaatctgagtcctggtcaatgcataacgaagtgaatgcagaaataatacatagattttatgaagatggtggtttaaataacaaaattctgttaactcatggtgaggactcgttacgcaaaataccatacgaaatcgtcggtaaatacaaagtgccaatgagtgagctagcgagcgtgttagaggaaagatcagacgatcctttccacgtaaaaatgactaagttaaactggtccacgtcaaattatagtattaagaaccgtgatgaaataaaagacctaattcaatatcaagtagcgaatataactactgatagtgaaatgaaggttgacgtgcgaagtactgagtacacgtctctttgggatacgccaattgagaaatcttatgacctgtgggaaatgtatggttcaaaaacgccaacacgtatccccgtaattccatggcgagtgagtaacctaggaccaaggatatataaaaatggattgccaccacaactattcccaagcacaactatcatgaagaagctaaacatatcattagataaattaaacacgactgaaatttatggaaactacagtgaattcgtaacgcttagcgcaatgagtgaatccgatataaagactttagactttggatggcgcgctgttggtaacaatttgtatgcaatgtctgaaatatctgaggaaaattacgcggaattatacaaagttgaagatataaaattcttcatggggtgtggctcagtaataactgctgcacacgcatgctttggattgggaagatcaaacgacgagttattatttcaactggaaaggaaaatgaatactggtcatggcacatctggtcatatgatcgcaagtgtgttagctttccaaagtcattttctgtggtatttagaagaagtatttgaaaattttcatagtggtaaaagtgtttacgtaaccaagttcaatgaaccaggatctggtgcgtaccacacgatacacgaatatagaaacgcaatacatgatatgaaacgatctgatacaaataagttatatccgggatatgctagaaacaatctaggaatatgcgagaaatttgtcagtaatctacaaatatagaagggaataaggctatatgaacatc

SEQ ID NO: 569 - DNA, 1938 bp, Unknown
  derived from dsRNAs of unknown virus
gaaattaatgaaaactttgttttcacttccaccataatgggtttcagtggttgctttgtcctagctctgcgctaccattggaaaaagcgcaatttatttattatttaggtatttgtacatcatgaaaagcaacaaatgctcccttaagaaagctagggatgctagaatgctaaagtcctttgtgaaaggaataagtagtgactattccgttaatataacatcaatcaacgattacaatcgtgataaaggtctaatttttggaaaaggggcactcgttcggcttgactctcatttcaataaattattttatggtgataactcagatttaacttctccgtttttcaagctgattccttacgcttctggtttccgcggattttctggatatgataacgataatattcgtaagcttatctttaaaacggttaaatctgttttgtctaattcaagtctatataatagtagcgatgcttatcgtgcatttgaggatgatcaggtaaaacggttaggtaacacttctctcattgttcctttctgtgatatcactgatggtttgattgtaaacgtcctaggcttcttttctagggattctaatatctcgtacgactcatatgctttagaagaggctgtgtcttgtgttagaagaattctccctgaggaaggattactaccttgttcattagaagaagcttatgatcgttctgacaagacaagtaattggggacctccctattggcttcctggtcggaataccattgatgatgattcgtttttgacttatggtgaatttacatacaatgtgtgtaaaaacattttggttaataatttgaaaatacctaatttaccttgtgttgctgtcattcgagtgcaacccaatggtacagatacaccaaagcagcgattggcctgggccgtttctcacatagtaacgttacttgagtcaagataccaaatacctcttgtgcgacaattaaaagatgtttatcacttttccgaaagcaagagtgaagaagcgacggatagcgttatgaacgaaattttcgatcacgctatcaagcacgatttacatctaattggttttgatgctaagctatttgatattagcgttccacaagttttaattaaggaagcttatggtattatagcagattggtttgataatgactcaagagatcgattagttgaattatcagaaattatgtatagttccgatcttataacgcctataggtgtgttcacggggagagaagctggtatctcctccggtatggcatttactaacacttgtgattctattgttcaacttatattattccattatgttcggttaaaacttaatgcgccagaagctatgtgtagaatcatatgtaacggtgatgatggagtttggattattcctggtctaacaccaggtatacttagtaccttagttggtgacttcggtatggtagtgaatcctgataaagtctcgtatagtaagtatgatgtttccttttgccaaagattttatgaatataattataaaattggtggcttgcatagaggtgttagatcattatatagagttttgagcagtatgaccgtttatgagcgaattcgccgcgctgatatgtggaatgattactgtgattcagttagatgtatcatgcagctagaaaatctgaaatggagtccttcatttgaagaaaccgtatctcttcttatgaaagctgatagaaagtattctcttggtatgaatttattcggaggaataaatgagctttatagccgtgctggtgatactggaaatctcgtttttagattaggaacgagctcgtgggagagaaataagattagatataagcttgataaaggaaatggtctatccgttgttaaacttattgaagatctattcaataccaccctttaagatgggctaatccaacttactcagtaagt

SEQ ID NO: 570 - DNA, 1770 bp, Unknown
  derived from dsRNAs of unknown virus
gacaaaaatatctcttgcactaactctaaaggagctcttgatttgatacttgagcttggctatgatgtagggattgtcaaccagatccgtagcagtatactaggatttatgaaaggtagtaagattcgtcggtgtagtcctttgtataacccaaaacttaaacacaaaactgcgataaaagtaattgacttgtttgatgcacagtttaggaatgatatttctaaacttcatcctagtattgttgacctcgaggattctcagaaggtcaagttccactcttttagtcaacgtcttccttacgaaaagatgaataaaggttttctcaccacacttcgcaagaagaataaaattaaagggaaattttatcttgagaaagctttttggcaccttcataaaactaagttcaaacattaccttggtcgatgccgtccactttctctttctaataggtgtaagcgtcttcctaaagatagccaatggggacttccttttatgactaaaggtttcttttcttccgagaaacatcttgatatcgctaagaagtgctataaacagggttatttggattttatacctgccatttttggtatgcgtaatcagcctggcgcggacgatatccctaaacaacgtataattctaatggtaccacattttgtcgtgattcttgaaaccatcttctctggagtcctgactggtatttacaagacctacccttggttcgggaaacttaggtctcaaaatagttgtgattatcgtgttactcaaattcttgaacgtagtataagtgatcaatggagaagagttagtgttgatttcagtatgttcggctactctctggaaaagatttttctattttactacttttctcatatcaagcttatgtttggaatcaaaccaaatagccatctttctggtctaatcgatagtatatatgaatacttgagatccaggctaattgtactaccagacttgacttttcttttttgcgataaaggaattaatgatggttctggtcttacaagtagttgtggttgtttttcccatatgctagtttcccacgcgtgctttttctatctctatggccattttccgctaggagatgaatttttggatatttatataagcgatgacggtatctggtactggtatggtattctcgctgatgttatttccactagactaaaggaaatgtttggtctttccttgaatgttgaaaaatgtttcgtgcgtgttggacaagctattttttgtagttctctttatatatgtcactaccgcccggataaagactatccgactctatgtcgtccaattcgttctctttatcgtactcttgttggtaacgtcttcaaagagaaagggaattttgttagtagttctggtgagccgtggtctgatgtggatgagtccattcgatggattacacaacttgaaaacgtgaagtttcatcctctaagactaaagtatgtaaagtttattgctaatggtgattatcggttcgctcttgggatcaagaataaaattggtattcgtggaatttttcgtcttgtcgggggcttcaaagatttcatgggtagtaaaattagttctgactttaaatattcccagaccgtatattctaaccgtgtttcttctctttggatctttcgtgccgtggatcatctcattgaggaaaacgaaaatacctgattaagatctaagaaattaaaataactggttgctcttctgagtttcctcgttgaatggtttgttcaacgggcctaatgggtt

SEQ ID NO: 571 - DNA, 1926 bp, Unknown
  derived from dsRNAs of unknown virus
gttttaaatataacaaatacgccgagaggcattaagctcttatagagaatatttagttgaaatccatatctgacggaaaacagatcaaccgtcgtaaggacgaaaccaacaactaactaaccaaattaaacaaaatattatggttaacaactggacaaacaaacccttgaaaaacttagggtctggaattgaacaagccggtagccgtttaggtagtaccgcaggtgaatttatcactgggacatcgttgcctggtgaaagcaacccactattaaacccaattatgcaaatgggaaaaggtgttgcagcaggtgcggcagagaacttgattaatcaaggagccgaccgtttatccaataggattaagaatataaacgaaaaaggtaatatgaagaataattacaaaggcaaaggaaaaccgaaatctaacaatagatcgaagaataattcgagcagaagaaacggatctaataataacggatccggtgcattcggcccaagatttaactctaatcatggcggtggtggaggtgaaccttcaaaatatggttactctggtagaaccagcgactcatcaaactatgctccgtttaatttaggacctgtaggtgatcctaaactcgggggatacatgaaagtcggaactccatattgtaacaagtttcactcgcagttcatccataccggatcaatacatgataacgctaattacctccgtaacacgtttacattgataaacttagattacgaccaactattctgcacctctaatagtgacaattataatataagtccaattgacacggccctttacaaaattgtaaatcagtacagaatggcaatcctttctggaactggaggaagtaaggccgctgactcagtcacgatggaatcgatgactttatacttccaatatacccagtcattacttgcatacatgatagcgttgactgctatcatcaactgggacccaccttacgcggaacagaattctgtttttcgaaaattgcagattatctattccaataatgtggagttacgtaaaacaatggctgaagctcaagaattaatgcaccaatactgtcttccacgtggtgtaattgagtactacagacgattttttactgtaacaaaaataagtagcttagagggcggagtgcatcacatgtttattccagaggaatttatcagtgcacttctagccaatgacgatgacttaacagaagttgttaacactttaagcaccttagtaagtgatataaagacgaatagtttaacaggtacgaacgattttcctcgaattacaactctactgttagacaagactccgttcgacttcgtttcattaagaacagcgatccctatgccggatcatcctattcgggatataaaccagatcactctcattaacaatggagcttggtctgcgtcaccagctgtaatcacaacggacaacgacgacgggatcttacgaggaaattataattatgattccaaagattgtcaaatgatatccgctgtggagccagatgaaatagagacttatgaatacgcacccctaattggtgtattccatgacgaacatcatcttttcccaatgtggaattatagtaaggttatcacaacgttttctaatcgcatttaccttcaagaaaatccaaacaacacgacttatggaatggatgtattaccaattcttttcgcatacgaagatcctcttgacttcattgcggtaacgcgaactatgcacgtttcaccaaccggcgagcacactgcaaaagtgtacaattcagctagaggagagaatgttagactatttgatctaacaatcgagcctgtaattgaagcgaacgttaacttattgaatcagttatatgatgtaagacaagtttaacatagcaggggttattcgttagaataactcct

SEQ ID NO: 572 - DNA, 1908 bp, Unknown
  derived from dsRNAs of unknown virus
taacagacttcagatacacccgcacaagtgaaagattacgatcgctcagatagacttgaggcactatgcgggacggacgcatcttaattgatatgtccaccttcactctttttctctttcccctgatgatgttggccttcgcgatgtcttacgtcttcgacgtagtatccggtggctattttatcgtcgggaactcctttttgatgagtggcttctccatgaagtctctcttcatatttctcctcaagcaattgatccctattgcggccatggtcgccttttggaactctagcatcaggtttggtgacaatccgacgcctaactatttacgttcaaagccgaatgtcaaagttatccaggatttcgtcgctaccaacacttttgagcaactcccaagtagcaaaattatgttggcttgtcccaacggcaaattgtaccctgtctgtttctttactaggcagatcttgaacagtatcgaccctgcagcggtgttatacgcttggaaaacttacaagcgcgtaaatgacactcttgccatgcggttgaaacatctcaagaagtacgtatacggtggtaacaaagttctcagtgatgagctcatacatgaactcaaatctgaggctgacagcctattcacagaactcacatcgtctgatgcatggaacggctttgcttccaacgccagccaaaacattcacgaacgcaactatgaatgtttggacattaacaaatccgcggctgccggtcaccctcacgtgcctggcgtcaagcgccgtgatgtgatgcctgaaactttcgtcacctgtgacgagttgctggacgatgattatgcgtttgagagatacatgccgactgatctctactacactagtgggcgagccaagcttaaaggtcgaaatgaggaggactcggcgcgcatagtcatgtattgtggttttccaaccatggtgatgaccatgctttattacgtccatcttacgactttgcttatgactttccaatggtgtggtattggtaagtcatggatgaacaacggcgctaacaagttcgctgagtttttccacgccactaaaggtatcgccccggcgggcatgcgttatgtgtcagtagatatatcaggatacgacagttcacaatctgtcgaggagcttaacatactcaaagatttccacacgcgtcttcaaactcacgcaaggattcaacagtcatacatcaaccggttcattgtcatgttcgatgcgatggtctatgctgcagtgcttctgccgactggcattgtactgcgtgtagttggtggcctcaaaagtggatggtctggcacggcctgtgacgataccttgcttcacactttgatagtcagaaggcttggagttaccaaatttcgtgtctacggtgatgacaatttcatgcttgtttctgatgatattacagatgaggatattacagatcattacgccaagtttggctacactcttaaggtcattcaatcgtccactaacatgggcgacatcgatttcctttctaagtacgttaaatatgacgcctacgccgatcgttactatatacatcgtcctaccgtcgagaacattgctcggttgatcttcccagaagagcaagatcccgcgcggcgtgacgttcctgacgaagtaatagcggcacaacgtttaataggtcatctcgttgacaacccattcaactctaagtgttcaggcatgattctcaaggctcttgacgagctgagagagtattatgccattgacgacgtaatcatatctgaggatacgaagagacgccatccatttcgcaacttcgtcaacgttccgagtaaaatcaatcttaaggacgtcacccgcgaaccggctctcacacatgttgtgtaagttgggttcgcctcgaacccctttcctg

SEQ ID NO: 573 - DNA, 1911 bp, Unknown
  derived from dsRNAs of unknown virus
gtaaatttccgaatttataaatttttaaaactaaataacaaattatgcaaattataaagtgtagaacactttggttgataatgtacatagttgcagaacaagcagttacagcatacgtacaccgccgttcagcaaaagaattaggtacagaatcacaaaaccacgaaactcgcaaagacagtttcggtctatctaaacgcattacgcgtatagtcgttcaaagccatatctatggacttgatcgcataaaatttaagtaatagtgccatgaaatacacagaaatatctagcaatacattggacagtatccttgacaaagagaaacaacccaatgtttccaatttattaatgggcatccgcgaaggaaagctcccaactccccgtaccccacttttcaaaagtgaatccgagtctgaagtgatggacggttggctgcagattatctcccgtatccctactgtgactcaacgtttaaaggattacgaggaatcgagacttagtaaagttggaccacaaggaggttacccaccacttgccgagagacaagaatctcttgaggactactggactaaaggccaaatcgaactcccgaaacccgaattctacgatgagatggtttcagacgtacgggcaagactctttaaaggtatcagtggcttaagaccacaaacatatgcaacggttatctcctcttcagcagagaaggacgctcttaatactaactcaggatgccctagttatactaagagaagtgatcctagcactcagcaacgtgctatttcagatgccgagtctggacgatgggaatcgtatccagcaatactaggctcgcgagcccaacgaggatcagacagattcatattcatgtttgccatgtcatgtaacctcgttgaattatcattcgttaatgttatccttgatgtgattaaacgaaatgaagtgttatcattctcagcgtggaaaggtttcactccagtcgtagactcactagataaacaacgagtgcgcgataaggtacaatacctcgctcttgattatacaaaaatggacaagcattttaacggattatgcactcaattcgtaattgatgttttaacaccagtgtttcagcctgaatcaagagagcttttgcaaagatcgttggagcatatcaacacagtagacgtcctggttgagcccaacaaaatattaacaggtttccatggaatgccgagtggttctggatggacgaatttagcggagagtattctctcgtttggtgtaattctccaaaccacaaaaattctaggcttagaactatccaatgatgcgatatgtcaagtactaggcgatgacggtttccttgggttgtccgacactaaccccgaagctgctaatgtattcagtgaagttgcatccaagtttggaatgattgctaaccccgacaaacaaggagattcacctgaaaactttaattatctgcaacgattcttcgatcgcgatatctcattcgatttagaagggagagatgttatggcaggtagttatcccggtatactagcattaaataccgcgatgaatccagagcgcattcacgatcccgcgaagtggggaccagagatggaaacactacggtggataatgattctagaaaactgtaacgagcacccaggctttcatcagttaatagaatactttatgaagggtgataagttcaaattaggactattgaccccgggcttcttgaaacgaggaattgtcgagtccttcaagacagctaaagaaattaaaggtttcgttccttcttacaaccaagaaaagatggataaaggtatccaagactttgatgttgttaagtatcttaaaacgaagcagtccggctagggctatttcttgggtaaaactctctcgagtttcctctaacgaggttcc

SEQ ID NO: 574 - DNA, 1809 bp, Unknown
  derived from dsRNAs of unknown virus
gtaatttattattcataaccctatgaactccgaacaattttctaaatacgaagtattctattggatatccggctttgtgctgcgacgcatccttgtgaaaaccgtgtttccgacttatggcctagcttcttatgagctgagcaaggatgtaagcctactggttgcaaaagtccttctggcaaaagtcatcttcccttcgcgtaccgacaaggagaatggtcgaaatggtgccccaagcggatctattaacccttatttaaatgaacctgaagatggaaatccgcagaattgacactctggatcttaaaccagaagtagacagtcagctttcccgaatgatgtctaatgttgttcaaggtaacgacaacataattgaaggccccctcgctaaagtacctaaaattcaagaattattcttggaatggtttgaagcgatgcagctgaaagaggctttaaatgagacacttttagataccgaacgtgctaatcaagataaatttggacccagatctatcgcattgccttggttagacaggattcctggtgtgaagaaatattttgaagtcgatactactctccttcctgatataactttaccgcaagcaccagaagggcgattacgaccattgacccttaaaactgcttctgagtatattaaaagaacgacaaattcaggattgccttacttacaaaagaaaggtatagttcttaaagaagctttagctaacttcgaacaactgttgtctcgtcaagatccttgtgtattattcactcggactcaggaaggcaagaaaactagacctgtatggggatttccttttgcagacactttatttgagatgatgttctatcgtccgctactcgaattccagaagaagagtggctatcgtgcagctgtagtaggacctgaagcagttgacaccgctgttagcagactgatgaaatttgcatcagagaacggactaaagttattaagcattgatttctctgcttatgacacgtctattcgcccggaattgagcaagatgtgcttcgaatacatcaaacgactttatcaagcttcacatcataaggacatcgattacatttatgatagatttgtttcgataggactttgtacacctgatggtatttataccggcatgcatggtgttcctagtggtagtacttttacaaatgagattgactcacttgttcagtacattattgccatgaactatcctcatgagaagcttgaaatgtttcagattcaaggagatgatggactctacgctactaaggatccagagaaactaatggattggttcattcaatttggtctgcaacctaataaagagaaatctttgatttctgatgacgtcgctcaatatttacaattgacatatgcacccgagtatgaagtatccggcgaattcaaaggaatttatagtgtatcacgagctttcaaccgcatgtgctacctagaacgtttcacagattttaccagagatgatattgatgggaagtcttattttgcgataagatctatttctatccttgagaactgtaagtatcatccatggttcgaagaatttgtaagatttatcattaagcacgataaatacgacttgcaagttagcgatcagtcaataacaaactatataaagttaagagatcgagaggacggacgcgacgttaattttaacatctatcagtacggcgattatgctcgcggactgaagagcttcgaaagctataaactagtacgacagttaacgtaaatctctcgtaatacataggttctctatggggtcagtgagtaatcacccc

SEQ ID NO: 575 - DNA, 1744 bp, Unknown
  derived from dsRNAs of unknown virus
tgtaaataaaatcaaccctcccactctatcgaaatcgtatcagtacatattgtggtatttaccaagagagaaccgatttaaaatttaaatagaaagaaactatggcaaagaaaagtatgccaggatttgtaggcccaatactaccaggtaaaggtcaagcaaaactggctattagtccacaaactccgtcacttaatgcgctgcaacccggtacttctattaaaggtgccgatactgctcttaaggcaagtagtcgttcgcagaatggtaaccaaggtgcgggtagaaaagtaacaacaaagaaaggacaacaaccccggaacatggatgtaccaccaaaatatactgctccggagttctcagatagtagtagcagcagcagtagttcagatagtttccagcaagattctaaaagaacaatcttttatgacgagaatagagatgcaccaattctctttgatctaaatttaaaagatacaacgactccaattcctcttgcacctgtcgaacaagatactacagaaagtactggaaatagtgattctagacttattattaatcttgctcaatacgctagaaattatgacggtcaaactggctcaacggctggttatcccgtttatgatcattacgttatactatataatcaaatggttaagaaggtgtatgcaactgtaagaagtaaaattgttgacgcatttacttttgctaatttctataattatattcagttaatgactgcagctcttgagctattttacgctactgatgccatcttatcgtatacttctacaaaagaggagaagaacactggagtaatgcaacttcagcgtagacttactgagattgatttattcacatctcagaatgagttaagacgcctattgaaaggttactggttcccggaagagttttctaaactaatccgttggacttatcaaatttataagacgtccgacaacgatcaagcatgtaattacatgttcatacctaatgaaacatacttttacgtgtctagttcgatgacccccgcggcacaaatcaaggcaaaggtagacttcgtcattggtgaactaaccactggcacttcagcaacgaattacactaaaatcgtttctgtccttgggcaaagctatccagaaggtcttattgaaggacttccatatagtacaaaccgcgcgcaatacgatccgcaacattacgaaattttcactaatcaacccatactctataaagatgacgcagttgacaaagtataccctttctcagctaataatacaaatatcatgtaccaaagaagttgtaatcccggtgttcgttcagggttccctttctgtttacaagatattcacgctcttgaaactagagatggagtaggtagtatagacttcttccagtgctttactccgactggttaccagacggataatgtaaacttaatatctaataagtatacatactgtgaaggtgacttctttagacctaggtttatggaaagagcagttaacgaatctgctgatatccacataattaaacagtcttcgaattcaacacctactactaattcaatatactttaagaaatccagtgtagcatctggcttccaaagagtatattttgataacgcgatggctccacttatcaatctaagagaaatgatggacgctcttttcgaatttacgatttaacttatttccgggtttgtcttactgtaatttagaacattagatgttctaaccccccc

SEQ ID NO: 576 - DNA, 1760 bp, Unknown
  derived from dsRNAs of unknown virus
gtaaaatttaaaacttattaaatttcttatgaaattatataaaataatccatggcacccgttctcccaggttattttacgaatacacagagccatcgacaacagctactcaacttaacaaacaaagtaaaatatggtattattcaataaaccagttcaacaaggtttaggaacaaacactaacttagttagtccaaatgcaccatttcagagtttagatcgaacaccaaattcggtgttaggccaaggacaaatgaatatgtcttcgccacctaaaggtagtggtaacaaacgttacacaccaaacagtaaggcaaaccacaaagcatcaggtagtcgttcaggaaataagaatttccgtaaaacacctactatgattaacaatgacaatcgaaaaccaaaaggttttccgcttattgtacctccgtttggcaatgacagcaattcgagcacaacaagtcaacgctctgatttcagttatgatatcacaggtcaaccaacgagtacaccctacagtgcaccaaaagatgatacactgtttaaagattggaaccgagctcaaactatccctaaaacagggaagaatggtgagaccaatgctgtaacaagttacacaaagatcttaacttgcgattttaaagatagtatcttagatccaacgtatagaactgagtgggacttaacgttcaataacatgattcgagatgtaatccgaaacactaatgcatccaaaggtgctttagacgtaatgactaaagatggtattgcggactacattcatgaagtttcacgattatttacatacttatacgaacttgaggtattaatgggatgggacccatctggacatgagaatacaaaccgagtacttcgtcacttagctcaagaattagctaacagtactttccttgactaccgaactcagatgaaagaggtcttacgtagtacagttctacccctacctatgcttaagtatttaagatggcttcgtgagtataagaacaaaaatgagatgccagaatctccaaagattgccttccgaacaacttctgttatggacttgattgacaaggcttacactggtaattcaactgcagcatcacaatggattggtaatgttacagcatctattcttgcagtccgagccttagatccgaaaattccggctctattactagataaggttgattgtgtggattttgtaatggttaaagattactatggtaatgcttgtaaccgtgcacattacgatgctgagttcaacaacatttacaataaccgattatgggctcgaggcgactttggaagtgcctctacattcccaatggttaccgacacttctgtggcggcattcaacactgtgaaaccagaagtattagctctagctaatatctcaactcaactaggcctagatttcactgcggatttaccgatggaaaatcgtggcggacctaagaatttcgcgaactttagcacttctgtagcttacagtcactggtacacatgtgatactacagcaggcactgatccatttgcttttaaagcagtagttaactggtttgaaaccggcgatgactcgacgttcatcgttgaaaataactctttagttagaggtattgcaattcctcgcggagatacattacaaatgttctaccctggaagatcaaacattaacatggctaagcgtctagcttttgctcaattattcaatcaattataataataataatagtcttcggacgggtagtggtttgccacccc

SEQ ID NO: 577 - DNA, 1767 bp, Unknown
  derived from dsRNAs of unknown virus
caacttatggacacgagtcacatccatgtggagggtcactgtgccaagccatacaaaccatactttgtgtccacgcgtcaaacacgaccgctaagtgagctggtcgagttcttgagcgtaacagatttgagtcatgatctctcactgagatttacagaatattattatgatgcaccaggacctgacgacttgcgcgggcatatcagtcggttcgtgaacggtgatgctggattaggagcgggcgtcgcatccattatcgaacaaagtgttgcgaaaattgtgcgatatgaagctgacgtaccacagatccgaaactggctgaatccttcgcgagtctcccgacagacttacccaccaaaatcaagccctggaccgtactataaactcaaatatggctacaacgagaagcgacttgcctacccaagcgccgtgttggatgcgaccttgatggtaaacaaaattcaaaatggaacgttttcgcgagatgacgatcggcctgcgggactggcaggccgaggacgacgcgttgacattcggggagaggccaagcccgacgagggtcgactgattttgacggtcgacttcatgtattacctcgtcgcctctctcacatcgcaagtgtatacgaagattctgagctacctccgcccaagccgcggaggagtgatgattggcctagggccgttcggaggaaagtggggcgcgttatacgacagccttctgggtgatggagagatcctggaattcgacttttcccgtttcgactcgacggtcccgccagccgtgatcaaggctgcgtactcgttaatcaaatctcgcttcgaagactgtcctgggaaggacgcgtacttcgcatatctgcgcagaaacatgatatcgacagtcattcttgatccaagcggcacagcctttcgcaagaagggaggaatcgcgtcaggcgacccgtacacatccattgtcgggtcgtactgtaacatgatcatgtgcattggtgctctgacaaggctcggcctcgagctcggtgtcgactatgacatctgggcgtacggggacgatggtctcatcaagttttactctaagaaagtcgacaaagccgagttcacacggactctgggagagcttttcggcatgatagtgaaagagaaggcaaccaaggtgtctgtagacgtaagctccacgctgaatgagaatggtgaatgggagcgtgagaacgtcacatttctgcacaacaactttaccccccgcgggttcccgattcgttcgatgtccgacatgcttattcgactgtactctccggagaaacatgtctggcccgatcagagtcacccgcgcccacgggagtacgggacatggctcctgtcgcgagtgtacgcctactacatcctctactacttcaatcaagaggctcgcgatctgctcggctacttctatgactaccttttaagaaggtacgacccacttcgcaccgaacgtccaacgctagtctcgagcttcgcggaaaagtggattccgatctcaggattggatcagagtttctttgacaagtgtttaccaacaacggaacaaatttcggaactgtatacgatcaatatatatttataagcatgctatctatcatctgaggggtgtggtgctgcgtacctgtgaaatgccgattcaattcaccactaggtttcgcgtaggtcgctcgcatcagccgcgccactcccgctcacccaaaaggccgtccccaccatcgcaaccggtgaagacccttagggataccca

SEQ ID NO: 578 - DNA, 1700 bp, Unknown
  derived from dsRNAs of unknown virus
gtataaaatttatacaccaataaaattattaaattatcatatttattatggataaaataaaactgatgcaagaaagcatcgacgtcttccttaccccagaaggtcaagtgcgtgcttccagcggttttcgtgctctagctttaggtaggcctcctaccccacgaactcctctttttaaagaccaagatcccgacgagatactctcaaattggttggatgttctggacctagtgtacgatggtaatccagaccttcgacctctaattgattacgataagtcccgaaaaacaaaattcggaccacaaggtggcttacgtcctttcgatgaacgtgaagaggatttcgacgcatattatactacaccggatcgacgcgattccagtgctagaaataaaattgtagaatggctggataattcagggatactcggtcatgcgtctgccatatgctttggtaccgcaaatgagttgaacaagcgaccattacaactggaaactgtagttaaaatggaccaactcgacgacaaacttaattccaattcaggatgtcgtgattatgcgagtcgaacagatccagctgttcaggctaatgcaatcgaagctgttaaagatgggacttgggtgaacctaccaatgattctcggctcccgttctcagcgcggatctgaacgtttcatttttatggctccattctccctgaatatagttgaaaaaacttatctctaccctcttatgcaacaaattcgtgaaaatggcgatcccttttttagcgcatgggaaggattctccgaagttgaacttggtttcaaaaatcagaatttcttctcagaggagtacacctatattcagcaagactttactaaaatggacaaacattttaatctgctacaaatgtccattgtattctctgtttgttggaatgttttccaatcagagcctagaaagtctttcaaatccctattacgtcatatccttgaaataccagttcttgtcagcctagacaaagcggctaccggattacacggaatgccttccggttcaggaatgaccaattttgcagagagtattgtctcattagttataattctaacataccgtgcctccggtttagatgttgtagcttgtcaaggccttggtgacgattcagtcatggctataagacggggcaaattcttagatgaagagatactggaattaatggaatctactgccgacctgtttggacaaacagtaaatccggaaaaacaaggcattagtgaacacacgacagtctacctacaacgattctttgacgacagaatccccaatcatggaatcgttttaggtatgtatcccagtatacttgctttaaatactgcgatcttcccagagagatatcacgatcctcgaaaatggagtaaagagatggaaatactccgatggattatgattttagaaaactgtaagaatctaccttatttctacaaactagttcttttctttatggaaggagacaagtatcaattgggtcttgctctccctgatttcttcgtaatgttaccagatctatacgaagagtctaaggctattaaaggtttcgttccaacttacaatcaggaaagtatggatagaggaatttatgactttacaacggtcaagcttcttctagaaattgcgagcatgcgcaaataacgcctgggtcatgatttccatcatggccac

SEQ ID NO: 579 - DNA, 1715 bp, Unknown
  derived from dsRNAs of unknown virus
gaatattattgtaatcaagcaatattgtttcagccaaatgggtagaaatttgacgaaacgtagtatcacaggtggtggtactgctgagcaaagctcggtaaaaccatcgaatgcgactcctcaaagcccatccggtggaacgagaggcaggaatctggtcaagcgatcagcttttggcggcgctgaaaactataccggtacggatgtgtacggtgttgttcatacaaacgcttccccaacagccttagacgctattctaactgcgtcaatgaacagaaagcgtgatgaagatgaagcgaagaagcgtgaggaggagaggaaggcgcaagaagaagcggagcaaaagaagaagcaacaaggagaggaagaagaggaggatagaagggcagctgaagaacgtaagagacagtgggatgagtggcttgcgtatcgattggaacttgaacagcaatgggcagatatggactacggtgacaggcagggtggaatagacttcggagatgatctgcccgtcggaatcggtccagatgaggaaccgtcagagccatcagatgaagacaaatggaatccattcagtcgagcatcattggagggtgtccatgagatgcacctgtcattactaactgcagataatgctgagactatttctgacgtcatgcgatattacgaaaataaaacatatgatgttggtggagtactcgcaatgccgtttttggataaattcgtacgcaagttaactggcagtgacaagatcgcaaagaaatttggtaagggacgcacaaagctttttaagagagcggctgcagccatgatcatagcggatatgtcacgcgcaattcgtactggggatccgtatgaggtattaccgagatttgaaactggctcccccttcggtataggtgaaggtggtgaatatgtttcaatgccatatcttgacagattgttgagatcagttaacgttgccggagccatctcacgtggtgaaccaatgaaaataagagatcttcccggaatgggtgatgtatcgcaggacggcgaaagtgaagatttctttccaggtatggcaaacgcaatcggaaatatcgtcggaggtattaaaccgggacaggtatcagttggaggtatgctacctttccaagcacttactgaattcgaatcgcattcagaaagaatcaggtccattcatggtataagggtaattgaatcggataggtactatacggtaatgtatgatccaacagcaaaaataacgtacatcgaatggaagccgactgaagacatacgaaacatcacaaaaaggaatagaatgggttcagtgggaagagaatggactgaggacgctgtggcggcaatgggcgtcaaaataccagcatggtcaaagcgagtaaaatacataaaggataaatacggaatggaaagcgaatcagtaaaacattatggatactctcgtggagctggtatagccacacatatgggtggccttgggtatggaaccggttacttttcatcatacatgccggaaaaacgctcaacctcaaagctgagtggtgatgcccttcacgattatataattaatccattatcatacgccgtaatgttgaggaacgtgcttcgccagtgacaatcgacaaagttttataatttactaacaatcataatgctgaaaacgttatattctagctataacgaatgcgtgattaccatatgaaaacatc

SEQ ID NO: 580 - DNA, 1746 bp, Unknown; identical to SEQ ID NO: 452
  derived from dsRNAs of unknown virus

SEQ ID NO: 581 - DNA, 1725 bp, Unknown
  derived from dsRNAs of unknown virus
gtttaaaatacacatttcaacccaaaattgataaagttatttgttactaattaacaaattgatataaatggatatcacgaaaatcccgcaatcatcattagaggcttttctcacacctgaagcccagatacgtagttccggtaatttcgagcgtatagcgacaggatctaaaccaacacctcgttcgcctttgtacaaaaagcaatcagctatttggattcaggaacgttggacagacattctctcgtcagtagctaaccaagatacggtcggattaataacctacgattctactagatggcctaaatttggcccgcaaggaggttttccgcctctcagcgatcgtatggaagatctaagtgcatattacgataacccggtgaagatcgagtcaactctgaaatatacgaacccttctcggtactggaaattagttgaacaggtaagatcagacctgttcggatctcagagagacaaaagacctttgactccacaatctgtgattgatagagatagaaaggatggaaaactaactactaatagtagttgtcccgactattctaaaagaggcctgccagatgtgatcgctaatgcagtggcagatacaataaatggaaaatggaagacttacccaatgatactgggctcaaggtcacaaaggggtaaatacagatttatattcctggctcctttttcattaaatatacgagagaagatgtttctacagcctttaatggatggaatcagaaaacacggaaatcctgctttaagtgcatgggaagggtttgatgatgtagaagcagctatgaatcgccaacagtttttcaaggcgaaacgctttacagcgcgtgattttaaggcgatggacactacatgtggggaaagtgtttttgagttcttttatgacgtaactcacgttttctttcaagctacatactggagtgacttgaaagaggtaatcatgcatgggattagtatacccgtgatgatcagtcttgacaaactggtaaccggtaatcatggaatgttatcaggaagtggacttacaaacattatcgaaacagtagtaagctatgccgttggtaaactcattgaagagatgataaactctgaacttgtaggagaccaagtgcttggtgacgatggtgccttttctgataatgcaacagatataactgatgaacaattagccaatgtaattagagatgcttctttattatttggattagtcgcccaaacggaaaagcaaatcatttctgaccactatacaatttacctgcaacgatattttactgagaatatcaaggtcaacaacacctcggttgtagcaggttgttaccccagcgtattagcactgaactctgcggttaacccggaacgttatcacgacccaagaaagtggggatgggagatggaaactctcagatggatcatgatacttgagaattgtaaaagactcccgtattttaaggatctagtaaaatttgtacaagaaggcgattcttataaattaggtgttgaaaagccaggtttcctcgataagggtattaataaaacttatgaggaagctaaaactattacaggtttcgtaccgagctacaaccaagctagtcttgatcgaggcattcaagattacgaagttgttaaacttttacgaaacggtctctagtgttagagatagtttaggttctcttagttgaggtaaaaagatgaaaatcttttcct

SEQ ID NO: 582 - DNA, 1702 bp, Unknown
  derived from dsRNAs of unknown virus
gtgaaacaaacacaaatcaaatagcattatttgtaagtcaaatatataatacataaacatatataatcaaatgactattgacaaaattacgcaagcagaaatcgattcgcaactaactcctgctgcgcagtcaaacgcttccggaaattttctttctattaacgctggaaaagcacctacaccaagaactccgttgttcaaggatttatctgaagatcaggtattggctgagtggtataaggtacttgaccgttatgaaagtatggacgtttatacgccattagtagagtacgacaaatcgagacgttctaaagttggtcctcaaggtggccttcgtccgttagaagagcgtatggatgacctcatggcatactggaatctacaaccctctagggaagtttctgacaattatttgtcggatctagatgaagatattattaaggagatgcgagatgaattattcggtgtcatctcagatcggagaccccttactccgcaaaccgtgattgaacgggacttacgtgatggtaagttaatcacaaactctggaactcctgattacggtaaacgtaatgatccagagataatagctaatgcaatctcagcagtacaggatggatcttggaaagattatgacatgattttgggaagtcgaagccagagaggtaaagaacggttcatttttatcgctccattcgcactaaatattgttgaaaagatgtatttatatcctctgatggatattattcgctcacggaatattccgttcttctcagcgtgggagggttttgcagaagtcgaacgaggtttcgcgactcaaaactttttcaccgaaggtaattactacgttcaacaagactacaccgctatggacaagtactttaacgaggcttgcgccgagctagtagccgcaatcattagccctgtattccaaaaatcgtatgaagatgaccttagttatcttttcatacaacacctgttgaacatacctgtcatgattaatttagataaaatcataagtggccagcatggtatgccaagtggttctggtctaaccaattttagcgaaacaattgtctcaatgtatatctgtaagaagcttgaacgtgattacgacttacaagtatcagcctgccagggcttaggggacgatttagctatatctatttcaacagatttagacccagaggacatcaaacgtattcttgagagtaattcagcagatcttggtttgatagttgaaccagaaaaacaaggaatttctcaggacacgatagtgtatcttcaacgcttctttgataaacgtataccgaatcaaggtgtagtgttggggatgtatcccagtattctcgctttaaatactgcgatgaatcccgagcggtatcattcacccgcgaaatggggagcaaagatggaaactctccgatggctaatgattcttgagaattgtaagaaccttccttacttcacagatctagtcgatttcttcataaagggagacaagttaaagttaggacttgtcgaaccagatttcttcgttacgttaccgtctacctacgaagagagtaaagccattgcaggctttgtacctagttacaatcaagaatctttggaacgtggcatccaagattttgaagttgttaagtatttactaagtaaacgttcgagcgtttaaggcttgggtcagattccatctggcctc

SEQ ID NO: 583 - DNA, 1699 bp, Unknown
  derived from dsRNAs of unknown virus
ggccttacacacggtagaagcttcaccaatccccgtttgggaacagtggaaaccattaatgagtaaggtgactagagatttaactctagacaagttggtctccagctatggagccaaccctctgtttactagaggcccgaacggtatttcgatactttcggtccacagggatctcccctgtctgaactatcatggtttaacagccaagatagagtctctaataaatcgcatttcagaaacatcaccagacatgaaaatgtctctggtgactcaggagttgatctctgagttttccgagaagtcggaaaatggttctgtcgctaaaatcgtcttcctgaatgaaaaatcgggtaagctaaggttgattgcgcagggtgactacctgtcacaatcagctctaaagcctatccatgattcactcatgaaggtactcgggaacatccctaacgatttcgttatggaccagtcctcgggaaaagatttggctaggaggttcacacagaatggttactgtgtctcctatgacctatcttctgcgacggatacgttgagtgtcaaagctcaatcgtatttaattgatttggttttaccaggtaatttaggtaaagattgggagtctgtcttagacaggcccttctcttataccttaccatctggtaaaacaggcatggcaaagtattctgctggtcagccgatgggtttcctatcgtcctttcctgcatttacattgcttcaccatgtggtagttcgtcttgcctattacaaggcttacaacaaagtaccacacaaatcaaaacgtttctacgccattatcggcgatgacattgtcatcggtgataaggatgtatccagagaatacctcaaagttgttaaagactttggaggtaacgtcaacttgagtaagagttgggttagtaataaccctaatagatcttactcagagttcgctaagtcctggagtgttgacggagttgatataactccaacatcacttaggatgttccggacttctctgaactcctggggtgaattacctatgtctatctctagacattgggaaaacactcagcagttcactagccgaaagaaaatgctgacaatctttcaaaggtttttcgccaaagaggcaaaaatcctagtggatctacttcctatccccccatttctgggaggttttggaaagagagatcatatccccttgagggataggatcgattccgtagcaattcgtctgtttattgcaaacagaatcttgtcttgttttaccacaatcacgtcacacgacagtgtcgatgttgttgaaagtgtatcggatatatccgatgcaagggctaaacgtttagctttatcgctatacttaaagcttttacgagataagcaaggtaggtggtatcaattgatacgccacaacaggaaaagttttcttgtctgggcaacatcgaatgatactccaatgtccctcctaattgatatgttagaaggtctcaataaagaactaacgttctccttgagagacactctgccaaccaaatcacttggatggatacgttctcagaatctgaggcgaaaagaatacgcctatcttccacagaatcaggttaacatcgacttcgcaatcgatgcactgaaatctgtgttagattccaataggtagggtgaggattgtcatctcacctgggatcccgaaagggatccctcc

SEQ ID NO: 584 - DNA, 1683 bp, Unknown
  derived from dsRNAs of unknown virus
gtaaaacttttaaacaatttaaaaatttatgctagtgaaaactaggtaattctaacaaaattatttatgaaatatgaaataattaaattaacgcaagattcgattgatatgtatctatctgatagtgcacaacaatctgcttccggatattttgaaaacttgtcgcgcggacagaaccctactcaacgtaccccgctgtacaaagatctctctagtaacgaggtgtttgatctttgggtaacgtttctgaaagcccgtatggaaagctttgaactagaacgtcctttaatcgagtacgacatgtctagattaggtaagtgtggtccacagggaggacttaaacctctagatgatcgtcttgatgatctattcgattattggcaactacccgataccgaaaacgttataatcgataaagattgtatcgagcaagttcggaaagagctatttggtagtgtgagagataaacgacctcttacagtcgaaaatgttattcagagagatgaatttgatgataaactcattacaaactcaggctctccagattttgcgaaacgtaacgatcctgccgttcagcgacacgcaattgatgacgcaaagtcaggcaaatggattgaataccctatgattttgggatctaggagtcaacgagggaaagagagatttatattccttgcaccatttagcacgaatattgttgaaaaacaatttctataccccttgatggaccatattcgtaacgcgaaaatcccgttctttgctgcatgggaaggtttcgccgaagttgaaactgattttgaaaatgtcaatttctttaacgatcaagtttcatacgtacaacaggactatacgtctatggataagtactttaactcaatgctcggagaactagtcttcgaagtatctaaagacttttaccaatcaaagttccacgacgagtggcggaaggtgatccagcatgtatttaatataccggtaatgacacagcttgacaagctagtcacaatgccacatggacttatgtctggatcgggtttaacaaatttcctcgaatcgatagtgtcgtactatctaacttgtaaataccgaaacactttacaggaaaatatagacacccaaggtctaggtgacgaccttgtgttcaactataatagtcgcaaacactccgaggaagatgtaaggacagtaatgttcgacgaatcagcccaactaaagttggtgttaagttcagacaaacagagattcgatcagcacacgacagtatacctacagagatattttgatgaaaggctgaatatcaacttaggtaactatcccagtgtattagctttaaacactgcgatgcatcccgagaggttccacgacgcctcgaaatggagtaaagagatggagatactccgatggataatgattctcgaaaattgtaagaatctgccttacttcgaagaacttatccaattctttataaaaggtgacaagtacaaacttggacttgccatacctaacttctttcaacagttaccaatcacgtatgaaacaagtaagtcgattaaaggctttgtaccctcttataatcaagaaggtctcgatcgaagtattgacagtttcgccactgtacaatatcttatgaaacaaagtgctataagctattagcttcggcggaccagatctccatctggtctc

SEQ ID NO: 585 - DNA, 1672 bp, Unknown
  derived from dsRNAs of unknown virus
gtaaaataaatgaaataaactgacgtgattatggatatcttacctatgcgtggactcaaatcgtcaaacttagtatcgggattttcttctcgaccttacgtcgcacccatattcttcaaattacattatacatgaaacaaccaatccgccaagttctttccgaacttaatgcatcttttgatgctattcgtagccttgcccgattactagagaggacaaaggatgggagtaatgagatttacctttctccaatcggtaaaacccatggcccagaaactattctcagtggttgggataggatctttaataataatcttggtagcatgaatgatgttctacttagtttagaagaatcaaatcgttccaaatacgggcctaggtctatcgcagccccatggtcggaacgtgctgctggtatagaaaattccttttcaactgatcaaggaaggaagattgaatccttcttaccagacagtggtaggttacgacctatcagcgaagataacgctgccaaatacattaagttacaaacgtctgcaggactcccaactatgctaaagaaaggaaatgtcctaatggaaacacttaatacacaatggagccgctactcaacaaccgatggagagtggtacataccagctgttccttttactcgaactcaggaaaataggaaaactcgtcttgtttggggctaccctctagtatatgttctagatgagatgactttctacagacccatccttgaggtacagtctaagaaaccctggagagcagcgcttcgatctgctgatgacatcgactcagcgatcacagaactcatcaactacgctcgtagtcgcggaaaggttcttctaagtattgacttttccaattatgacaacactgttaaggagactttgcagagttatgcttttaatgattactttatgagtctattccaaccacaatacagatcccggttacaggatgactcggaaagatttaatagaatacctattataacgcctgatggcatactttctggtaaacatggcattccatctggttcagcttacacgaatgaagttggatcagtggtgcagtacggtatctcacaaacttttgatgagaacctcgagatatttcagatccagggtgacgacggagcttacgctaccttcgatgccgaaggtttaaaagaccatttccgttcatatggactggaagtcaatgatgaaaagtcttacatatcagatgattatattgtatatttacaaaatttatatcatactgactatattaaagacggtttaattcgtggaatttatcctttgtaccgagctttactgaggattgtctatcaagagagattcaatgacttttctgaggatgatattagtggtaaagattactatgcgatacgtactctttcgatacttgaaaattgtaaagcacatcctttatttaaagaattcgtcaagtatattgttggacttgataagtacaacttagactttagcgaccaaggcctttcatcatatattaagatgcgtgaaaagcaagatggtaaagacgttaggttcacggagtataagagaggagacgggtttggtattaaatcattcgaatcttataaacttgctagagagcttattgtttaattaatttcggtgtaacacttttgtgctacatc

SEQ ID NO: 586 - DNA, 1629 bp, Unknown
  derived from dsRNAs of unknown virus
gaatattatgattactatttagtgttctggaaatgaatcctatcttaagagagattcccatcttccacaataaggtagatattatatcaaaactcaagaagtggaacccgaccgatccattaccagcgcataggagatatttaactgatctcctaagtggaaaagatacatacgaagcagtcagatcaggatctggggtagtggataaggctagattagcctttggtataataaattatattcctggagagcaaggtcacttcactgtggaactagcaggaagagtcgctcctacaaacgatcagatagctattgagcttggatacgacgagaggcttggtattcccgaaggaaactctgtggaaaacccacactacggagcaaataatacattatacgaaggctcaaacacaatattgcgaccatacgagccagcagcatctgtgtttttggtaaggaataacttcaactcggcttctgatagcgagctagttgtagtacaccgtaaggaaggtccgcattcaattagagacgctagccgcctgccaagactaccccccgttttaacgtcgtcggaaaatataccaatttccttcgactttgacacacaagataagacgaaactattgataattgggccaccctttgactatagaggaggtgaatcaccatatcagcaaaggcgaccattcatcgcatactcaccccaaacaactaaatcggaatatacccagattgtacgtgatctacctgagggacgatcaacgaactggctcgagttagaatttgattcatcaatacgcggagaggatacagtagttgaagtcttttgatcataaagcgtaatggacgcgcaagagcatagtgacgatgactgggaagccactgaaggtgtcctacaacgacttaaacatagctgctttgcgatgcacatgttatatagacgtagattcttcgagtccaagaagcgcctcgcatactatgatgtaccaataattggactttcagctatgaacagcgttcttatcgctggagggaaggattttataccgagacaagtgctacaggtgttgacatgctttcttgcggtaattgtaggaataattcaatccataaagaactactttaaaattgacgaaaacagagaaaactgtctggttacgttcaaggatctttttaaattgttctgtgagctatcgataatgcttgatcaaccacgattcgcgagagcggttgacccaaagaagtacaccattgataagggaaatgaatatcaagcgattatgtctaaagctatactgttggaggataatagatcaaaaatgaacccgatatatgaagataatcacccatatactcctcatgtaagtggcatatcacagctatttcgtggtattggaagtgagacatcgtctaaggtagatgaggaagcggcaataattgaaagacaaacgtcaatgctcccggaaatcaaaagtatggaagagatcccaataatacctgacccacgtggtgacgatgagatataactaaagttggatacatttcctacgacattatgtcgaaatgccgtgctaaatgggtaagcccttaaaacaggatgccccttgcgaaatcatatgaaacatc

SEQ ID NO: 587 - DNA, 1587 bp, Unknown
  derived from dsRNAs of unknown virus
gaattgaaatcccttcctacgataggaaataaggttaaataatcaagagagagatggactataataatcgtatacgaccagtaaatgtaagagcacgtagtagacgagcaggctttagagcagcaggagcgggctacgttagtcaatctctaatgcgtttcaaagtacacactgataatgacggtgtaggttatatgcgccttgggttgaatgacgaaagcgattcgtcgttagtagatagcttcgtatatcgtaataaaattgatgatttgtctacaaagatgaacatatctagtgatttggctacgatcgaggttgtcgatttatttatggagatgcgtgatgaaatacaaccaggtcaagtgttcgaaaagtcggagatggataagttcaggggacgtgttgatctacaatcgatgatctgtaacaagattggctataaccactcttcagagtggtatggcgcgactctacgtaatgtgtttcataagcactcaccattaatccattacactgaaccgtgcctatttgatttcattggtaacgaaatcgagatatcggaaacaaatagattgttacattatatgtcaacgccagaagatgtgaataatgtaaggcattcagataggataactgtatactcactaggtgttaagataacgttcttctgcatgacaacatcttcacgtacaaggacggatcttgccataaatctaaacacaagttcaagccaagatttatctcaagtagtagaccatctacgtatggccgataaagtaacgattggtcaaggtagatcggaaaaagttgtgccatttgtcatcgaaaatatggatctggatgagggcacagtgataatgcatttatttaagagcgaacaaggcgttggtttagtggattggatggaatattgcgtggaccaacttgatggtcttctgaaatcgctattgaatacactgacgacggagagagatactgcgtattactcacgtggacttggtgggagtttcccagctaatttctttagatcattacgtggtacaatcgcggcatacgtgaacgaaccatgggaaacgatcgcccgattctctaatagtgtagacattcggagcattctaatcgcatatacaaccagtccaaatataagttcgctgccaatgagagaagcattatcgtttggtaataatgtgaggaatgtcgaaatgtttgtcaaacacctactgcgcttatgcatgaaatttgatacgttttacgatgttatcaattttaacacaaccgacagaaatgtatatgataggcagcgacaattacgtgtgctagatgtgctagagatgattagtaaaggttcatataataaatatgttgacttacaagatgactcgatctttcaacttatgcgtaaaattaaacgcaaagaagaagacgcaacattagaaacggagcaatatataactgagtcagtaacgaaaatatccacttttctcaacgatgaatgagaccttatatccacgactggtgaaaagtactgacaatacccctaaacccggatctatagtagggccggccgcggcaaaggatggtaacatc

SEQ ID NO: 588 - DNA, 1588 bp, Unknown
  derived from dsRNAs of unknown virus
gaatatttttagactaatttgcaaacaatgtcagagagtaaggagatctacactggtgatatcccaatacctacaaaaacacaaacaatcaagcaatttgaagaagaggagttggccaagattgatgatgaaacaaaagaacgtaaatacatggaatttacgaccgtctcagaaataatggctaaacctgaatatttctcgaaaataatcgaaacccctcaatttcaagctatgttggaaagagaaaagagtgatgatgtagttgaggaaaaaccagctgatgaaaaacctaaaccaaaaactgaaagtgtttcaagtgaaaaaccagaaagtaaagatgacgaaccaagtgcattagcagttgagatggacttaccaatgccagaagatgaaataaagattgaaccagcagatgttaaagtaacagctccaactcaatccgattttaaatacaagcgtagtttagttgatatagttggtaaattaaagatatcaaagcatggtgacatgttaatgttagatgatgctggtattagcgatttattaactacatatagacatggtagcgaatcaaaatttgattacaaagcaatgaagataatgcaacaatttattggtgctggtcttcctaacaagctagaaggtacagaagacttaagaatgagtatggacttattaaatttcttcttatcagaagaattttcttctaccgctgcaaaaggccatgaatatgaattaagtcaaattaaaccacaagttggatcatttgtcgaattcagtagtgctttagcagctattactggagataatggtatacgtgaattctacaaaaataaacttgatttagaaccgattgatttatcatatgagactcgtaaaggtaataaagggctaatctataatgtcttaactaatccttcgcgcctcccgttaatcaaaaagaagatgcaagcttacaaatatttcactcttacctacgatgagttcaaaagtgtgcatagtgagatgatgaacgaaacattcttacagtatgtacgttttagaaatgctaaagagcgtgatgttataactgttgattcacataaagcgacaagatatgatagatgcactgacaccaacgtaaacgacttctataaatcttgccttccaaaagaaccatatccaatatcacaatatttgttaactgactcacttgagcgcgcaaaggctgaagtagcctcaataacacaaaattctcgtagtttagctacttatgttcaatctgcagccgcatcgatgatttcagagttaactcgtatcatgcctggcgaaggagcagattttgcaagatcggtaagtgccttcctacttggtggacaacatttctcacttgaagttgatcaagatgaagtaagtggtagcagagatgtcatgatgatagctcttaaatcatttgcaaatctacaactgcttgatatgaattatgttacatcaactactaaagcaatgttgctttcaaatgtattacttccattctatgaagaaattgattacacgtcaattcgtgaagttaaaggtgtgttagaaagaaaagaaacacaaggaatcc

SEQ ID NO: 589 - DNA, 1575 bp, Unknown
  derived from dsRNAs of unknown virus
gaatattgtaatgctgtctattcaataacatgaatacgctatcctacgcaaagtacagtgatggtgttaaaacgcatgttaatgcaaagaaattatttaaaacaagacaacgttcaattctaggtgcatttgttgttgcgtcgtcaaagacgacgatcgatcctaatgcattattgatgcgaaaggataactctcgaatattcaatgttgatgaagcagatgtactgctaatgcagtcaacacgtggatacacacgagacaaagttatagcatattacgaggctgtcactcaaatccctcaggcatctaaaaatttagccgcttatacgaatttgaaacatgatccacctggtacaatagagccacgtgaaatgacgaagttaccagagataatttggtacgcgaactcatggaccggtaattcttgggtgcaacatttagtgaaaaatgacggtggcgtaccttgcttttggacgaaggatcatactgaaatatccgatccatttagtaaggcgtggagaatttacgatgcaaaattcccaatgagaggatggagaataacgtatgatgtacacaaaacaaaggatcatgtctttgagcaattgcttaagtttttggagaaatacgctgatgaaccagtagtccatgtgtggatacaaggtacattacagggtcgtaatccaaaacagaccgttaatgacctaagaaatatgattacttctgaatcggcgtcatacgccgatggtgaagtgtcaaacaacatgattccacgaggcatacaaaagaccgctgaatacatgtcactttgggaaacgccattatcggaaacgcaagatttatgggaggcttatggaggacgtgcgccaatgcgtattccaataattccgtggcgcgtctcaaacctcggcccgagagcctttcataaggggatacctccgcagctttttccatcctcaacgattaaaacaataatggggatggataagagcgatttacagtttactgaagtatactgtaactatagctcatttgtggaaatgactcagctaacggagaatgatgtgaaactacttgactacggatggatgcctgttggagcaaatttattcacaatggccccgattacggaagataattacactcacctacttaaggttaaagatccagacttctttagaggatgtggatcagtggtaacctcttcacacgcttgttttggactcggtagaactaacgatgagttgttatttcaacatgaacgaaaagtccagacaggtcatggaacatcaggacatatgattgccagtgtactggctttccaaagccaattcctatggtacctacaagaagtatttgataattacactagcaataaaagcgtttacatagccaaattcagagaaccggaatctggcgtgtatcacacgatacatgagtacaggaatgccattcatgatatgaaacggattgatagtaacaagttatatccaaaatatgctagaaacaattttgagatatgcaaaaagttcgttaatctgctaaaagtttagtagggaacagcggtgcatgaacatc

SEQ ID NO: 590 - DNA, 1483 bp, Unknown
  derived from dsRNAs of unknown virus
gaatattttgagagacacatacacattttaaattgaaaacatggaatttaatattactgatgaggtagaggattatcatgaacaaattagagatgtactcgaagacgctgtagatttaattgatgataatcctgaggagacttctcgcgatcgtttggcgaacgcaggtcttgaagagatctacaagggcgtcaagaacattaaagactgtattaacaacccgcttgattcgcgtcttgaatatgttggaatcgatgctttgcgatatgtagttagttcataccatgcacgagattcggggctcgaaaaatcactgcgcgataaatatgatgaacgtgttctcgtaacgcaacgtcaggaagcgctaatgaataagatatcaaaagaacaaacagaactggtttcaacgcgtgcgcaattgcatggacttgaaaaggagctactacgtatatctaatgatgaatttgatgtcacgaaaaggctcaagatgaggtctctacaggaagaaatctctacatatgaatcgatgaagaggtctagtgaagagcaggtggctaaggacatggccattgtaccgaggatccaagcggattacgatgccgtgattcgtgaagttgatgatctattaaatatgacgtcacaagtattgtatggtccagaagttatgcttctatgtgcaccaaactatgtaattaataccgatgtgaacttgccatacataactagcagaatcagtgatgagattgagaacggaatcgtgccaacgttaaaagagcatctgaacaagataaaactctttaaagatgaaggcaagggatcggaattcgcattgttttcgggatcatcaaatttaccacaacctttaaaggctcgtggcgaagaacagagtttattgtccggaccgctactttctagttataatttctttaagaattcagagattggaaaggtgattcataacatacacgtgaacgcgcttttcatgcaagcattcagaggacaggaatttgatacagctcgacaaaatgaaatcatgatgaaggatccaattaaaaacctagacacatcattaatgaacgaaatgtattttctaaacttaacgtgtatgtctggctacgatcccattacctgggcacggtgttttggagtaccaattagtggaattggaaaacaaatactgaagggatggaggagtggcggtaaaagacccctaaatgctgacggcctaaggaaaatattccttgaaggtgaggtcagtaacgaacataatatgctacttgatgttaaccttctcgagtacaacgaatcaatcaacgataagatgacagagaagcgtgacgcgcaaattgcagcattgaacgacactaaactgataactgagcaagttaaagctaaaattagatttgataagcttataagaaagggcgcggattagttatggtttgatttacgtctagttacttttcttctcaaatgaaacatc

SEQ ID NO: 591 - DNA, 1498 bp, Unknown
  derived from dsRNAs of unknown virus
gaatattttgagagacacatacacataaaaatttgaagatatgaaattcaatattaatgaagaacaggatgatgatacggctttcgaagaagtacttaatgacgtaattgaggcagctgaagatgtaattgataatgaccctgaagagactgcccgtgatcgcttggcggacaagggcctcgactatatctacaagggtgttaaaaatattaaagattgcattaataatccacttgagtcgcgtcttgaagatgttggtattagcgccctacgatacgtagttagttcataccacgcacgagattcaggactagaacagtcacttcgtgataagtctgatgagagaattcttgcctcacaacaccaggattcactaatgaataagctatcaactgaacaaacagagctaatctctagtcgtgcgcaattacatggattggagggcgcattacgtgacatatctaacggtcctgacgatgatattacgaaaatgcctaaactaagatctttaatgtcagaaattgagacgtataaatcaatgattcaagctagtgaagagcaggtagctaaatatatggtttcgctaccaagagcgcaggcagattacgacgccgtgctgcgtgatgttgatgagctactcgaaatgaaatcgagggtattgtatggcccagaggtaatgcttctatgtgcgccaaactatgtaattgacactgatgacgacttgccgtacatcactgccagaatcagtgatgaaattgagaatggaattgtgccggaattaaaagagcaactgaacaagattaagctctctaaaaatgataatggagctatggagcttgcgttattctcggcaacatcatctttaacacaaccattaaaaactcatggagaggaaggtaacttactaaatggacccctgatttcaagttataacttctttaagaattcggaagtcggaaaggtgatacataacattaatgttaattcgttgttcatgcaagagttcagaggagagaaatttaaatttgatccagcacgacagaatgaaatcataatgaacgacccaatcaaatcattagacacaacattaatgaacgaaatgtattttctaaatttaacgtgtatgtctggctatgatcccatcacctgggcacggtgttttggagtaccaattagtggagttggaaaacaaatactgaagggatggagaaatggcggtaagatacctctgaatgctgacaagctgaggaaaatattcctagagggtgatgttagtaaagaacacaacttgctactagacgtcaacaaacttgactacgctgaatcgttcaaagataaaatgagcgagaagattctagcgctgaaaaatactgacttgctaactgagcaagttaaaaacaagcttgaatttgaaaagacgtttgacaagctgaagaagtctagtggtgaggtgcaatttgtctaacatttcgttacttttcctctcaaatgaaacatc

SEQ ID NO: 592 - DNA, 1396 bp, Unknown
  derived from dsRNAs of unknown virus
agtgcttacggatcaatgatccgagagcggaaatataaccagtggttatagttcactagcgctaactaggttagcacctgagtaggaaaggtttccagacatacattggtatgtgaccgaaatcacagctcaaataaataataatatttaaatgataaataataattatactaaacaatgtttaacatattcattatgcactataagttcggtttcttccagacagtttggttctaatccgagtggtaaccgtaaggttacttcgaataagaagaaaacagtttccccgcgcaaaagcggcggttctaaagttgttttcaaaaacagagggatcattaatcataatttaggattaatggctccaatatttaacccgttaactcagcattctgagtcggaaattaaatattacttcacaaagatggtagaagcacataacaccatgatcaaggatctgggcgtggtctacggtactaaacattacaaagcaatttgccagtattgtttacttctttgtgagggacacagtccacaacctgtggatcgagtgtctaccggtaaggttgataaatggcccaaagtttttgggtttttgagacctgtctatcattctattgtacctaccctaagtggtaaggtacatgaacctagtacaagagttgagaatctcagactcttgaagactttattcaatgtgaataaagtctgctccgattactctggaatcgatgttagcaacttgcaacaaagatttgaaattcctcgtgaatgggaagattcctttaaggaatacttactaaacacgatgggagaacctaaacctttagaaactaatagtttcagggttcaaggtttccttgggaatagaaaagggcctaacggcgtatcgaagattgaatcagcaggtatggaagcagccaagctactatcatcaccgctacacaagcattttaaaacgctttgtgtcattactgataatcttcccttttatgaatactttctgcaacatgcagaaaaattcaccactgattatccaaagtatgaccttaataaggtcattctgagaaaattagtggcagttcctgataaaggtaataagtctagaacagtcgcaatttgtgatgtctggactcaaatgctaatggagccgtttgaaaacgtgctcaaacacaagatgaatcatgagtttcatgataaatctgcgtacttcgaccatgccgagggattcactaaggtgaataacctcgagcgtagagacgatacaatatcgatcgacgctgagcagtggacggataacttcccatctcgtgttcaatacctggtagtgaatcaacgatttggtcaacaattcgcggtagcttggcaaggcctagctattacgtgtcattggaatgtc

SEQ ID NO: 593 - DNA, 1369 bp, Unknown
  derived from dsRNAs of unknown virus
gaatattctctgacgcaatatatatttttgtagaatgcaatacaacgcgatgactgaaagtggacaaagacagaggtatcaacatgatcgtagtgagaaacgaaggcctcaatatggtctcgatctcaccgcaaaatatgatcatgaagaacgaatgaaatcacacgagtctgaactaacggaaatgaaactagcgcttgaaaagttatcgatgggtaaggataaaataccaatgttcttcgacccagatgatctggttaagggcagttatggagtccatgttgataagtacttaggcaggagccctagtgacggccccgctggttatgttttccaaaaagtgacgtattcggctggcgccattatcaataaaaacaacatcgcaggtatgtataagttgtgcccggatcatatgggttacatttatcatgagggaagcacagtgttaacaatcgctactggtgatgtgaccactggtacggacgtcattactgctacggctcatgggctgctggacggcgagaaagtcgtttacgctgccaacggtggaacggtcatggctggtctagcggatggagttcgatactttattgtaaataagactacaaactcgtttaaactcgctgctacagcaggaggatctgcgattaacattactggtactggaaattcagcacaaactttaacggtgagtaatgaagtaaggataaaccaggatggagccgatttaagtggtgcttcagatccgacgccatccggtatttctggtgaggcgaaactggttccaggcgatatgatattaggagcaattctacaattgctagataccagatcttctgataacaggacgggttttattactgcagggttggtttcaaatgactcagctgtcccagattcgtacggagccgatttggcttctgatccaagcaattttatcacaggcagtgccattagtggcggtagaatgcatgcggcggctggtttgaaagcttgctccgtggccagcccgaacctaaacatttacagccctacaattgtcgctaccgctcaaagtgatctatcagccgctcaaattggagctccaattaatgcaatcaatgtctcaggagtacaactagcagattcaaatcaaattcggtttgtacttaacgtgtacgcacttgttggagcgagacagaaaacgatttctcattacacacaacctgatccagcatttaaaatggaatgcctaacccgccagtttgcggagcaccccgtgtctatgacgcactaaaaagtcaagttataattttacatcatgcgagaatgatatacggcctctaatgcggtttgtcaagccgggttcacattaaagagatgaaacatc

SEQ ID NO: 594 - DNA, 1172 bp, Unknown
  derived from dsRNAs of unknown virus
ggaataaaattcttttattttattcatttgctacaccgctttcacacaacttaatacgattataactaccctgaccaccatgtcatcgaacaacaaacgatcatttcccgaggaccctcccgaggtaccaaatgctggcacatctggtgacagtcacactgactcaaccaaacgcgcaaaacctgatccatcacccgatgaatctactaccgcgccctcacctgctagtacaacacgttcgtctagtaacgacacaagacccgtcgttcacacatcgaacacttcacgtaatgaagaagatggactgacatcactctccattcaaatggcttccatgcctagaatgaagcgtcacaacactcttctcaatgtcgagctcaactgcatagatatcttctcttgcagatactacgactacgctctccgctttctagatccatacgaagccatgagaattgccattaccaaggaaaacttcatcaagtgtattaagtatttgcttaattgccgtctacatgacgtagcaggcaaagcaaccggacatcgatatcctggaagaacagttgccggttctgtttatcagatcccaacgcctctagcgctactcataagtgacgtaggagcattccagtcgccgagcatgggaactactttcataccagttccacctcgacctccaatcgacaagtctcaagaaattggacaacaagtaggacacgcactacttgcatcttttgcccagttcgtaggtcaactaaacgatcatggactctgcaccacgtgcccaatctctcgcgacgtctccggaacttcattctggctctcgcaggttactacaccatccgagcttccgagtgacgaggattcagatcgaattcttgttagtaccagtgtacttgaaactacaccccgcgacttcatgcaacaagccctctcctccttcaccaggaccgacaggactcccacaatgcttaagactttcgagtcttgtgtcatctccgacccacaagcaatatgccttacttattttactaatcgctgatatatcattcttcttatatccctatccaaatagcgagtaaatttaaattaaaatctttcatcagacccattttaagggactgtagtggttaataattcacccactttatttaacaaaaatttaacattcc

SEQ ID NO: 595 - DNA, 1170 bp, Unknown
  derived from dsRNAs of unknown virus
gatgtacttgcagtcacaggttccggggttcttcgacgcgtgtgagctcgcctccccacgctacgtcgtatccacgttcattcgaaaatatggcgccggcgtgggcctggaaggcctcgatgcgaccatcgcgagcgggtggcaaagaggacgtgtgatcaagaccagaacgagaagggatctcgcccgcacaggctggctccgtgccatcgccgacggcgtggcccaggacctgaaagacggttcccggcagcgggtcttacacggtgcctttccgaaggcattcgtggacgaagtccgcaaggtccgcgacaacccggcgaaaatgcgcacggtcactccaatggtgctgcatgcacagaccaagcatttcacgttcaacctacggctcaacaagcgtgcctcgagctggtggaatgcggcgccgtgggccatcggcatgcccatgactggcgacggctataaccacaaattcgcgacggtcgcgcaccggcgatggcatagaccgttcgacttctccacggctgatgccaccttcggcgccacgctgatagccgaggtcgcggaagcccgcgctcacggctatcgtgaccatgcacaatgggcagagatcaaggattggctgcatgcgaattatgaagacctccagcacggtgtcatctactcctacgcaaccggccggttgtactccaaacgtcgtggcctgtcgaccggccagacgtctgtgtccttggataacagtcttgccgtctacctggtcatcgtcggatcactctgcgccaccttcaaagagagccctcagaccgtcatgaaacgtttcgacgtgaccaacatgtcagacgacggggtgttgcactccgacaacgacttgacacccgggcagatcgcacgcatgcagcattgggcgctgactaacaccggcgccatcgtcaacctcgggcaaagctgtgacggtctgctgggcatcgagttctgcaagaaaaagttatgcgacccggcggcgttcaaggcagacttggcactcatacctgcggagtggcacccaaggtatgcggtggtccacgaccgcacgagtctgttgcttcgccagactgccgtcccgtactcgaacagctacaagacactctgggagcggtgcatcgggcatttattgctctgcgcccatcaccc

SEQ ID NO: 596 - DNA, 1141 bp, Unknown
  derived from dsRNAs of unknown virus
gataaagaagcgtgagatgaaaaactatgcatacaatatctatcattcgttctctacaggacaactagatctgcgtaaattagttttaacagatgagcttttcactccactaaccggggcatttataaggaatcaaatttctgactctggcttaaaggtaagattagttttcgctgtatctttcgggtttatagttatcgagacattcttcaacttgataattaagcattacacaaagaatcatgattgttatgcaatacatgggtttacccaatctcagttacgggacctaaccatgtcattagataaaaattttgtactttgtattgattataaatcgtacgatcaaaatgttcctgcgtttgttatatccacttgttccatgatatcagcacaaattatgggtctctcaaattataattttaagatttttaaaatcctcgtcgcctattttattacctgtcctgtgtttcatccggaggttgagtataaagttaaaagacgtggtatcccaagcggaagtggatttacttcactctttggttctctatgtaacttatacatgctatcagtgtgtgtgcatagacattgtaaaaataataatattagaatactttctgtacaacctaaactaattgtctcatctgacgatacgatgattagtacaacatttgacttagactttaaagatataagttctttattaaaagaaatctttgatatgaacgttgaatttgagagtcactcagtacgaggtgaatctaaggtatattttcttggctcaagatgggaaaatggtaatcctacaagaaatgttaaccggatgttagccagaatatgttttggaaacgggaactatccaggcatgtccgcaaaacagatgtttcaaagtaggtgttacgagattctgggaaatactagccaatactcagaattatacgggtcattcaatgtaccgtatccaactagagtcttccgttcattagagcttatggactacaatactagattacttgcattagaagacatgcaagggaaagagaaacgaggcgtttggcaaaacgttaacctcgacagaaattctgctgactttgtttatctatctaggtaaactgtaaaagggcttgcccctccgtaacgg

SEQ ID NO: 597 - DNA, 1128 bp, Unknown
  derived from dsRNAs of unknown virus
gcacggggagattcagatagggcacactgcagtacgtggtggagcggctcgagacgcagcgaagagcgcgggccatgtgattgagaacgagattgaccataagcgatatggatttagagtaactgaacaatctttggtggattccttcggcgtgattcgcgcgtgcctcccacgcggcgatgagtatgataggtggatcctccatgagatgagcaaggtcatcactaaattcctcatccttccagggggatgggtgtatcgctggacgttcggcaacccgagcggcccatggacgtcaatcctggactcgatcagcaactggctttcgactcgcaccgccttggcatcactcgcagtcgagccggacgacacgtcctgctggatatatggcgacgacacactgattggctttcggagctggacagcatggcggccaaattcagtcattcagggcgtattattcgacaagtttggcatcctaccgggggatgcctcatacgggtccctttcgtcatggggggatgagccgggtgctactttcttggggtgttggatgaaggacgggctgtatggacgcccgctggcgaagtggcttgatgtaagcgtgctgcccgagcacaatcatcggtcatacgccatgcagatgaaacgatgtgcatatcttgaagccgcagcagtatgcacgctggataatcaggactacttccaagactatttcaaatgggtgaactccaaagcgccgccacacgccaggatacgtgaggccgcattacatgacgctatccgatccaagatggtgaaggcacatacttcgttcagcaatgggggcgtggatacacgagagtgggaaacgggcgccaagcttcggcttgatgacgccaagtctgcttatagtgcatccaaagtcgccgggaagagcgtagatccgtccgcacctccgagacccctggtgagtcaatggttatccaacccaccaaggggcgcacgccgcgggccctcaatactcggttttatcgtggaggacctaagtggggctacattccgtagacggccccgctactacagcccaatattgggcgggtgaacgcatcgtgcaacatacgatggcagccccacagagcaatacca

SEQ ID NO: 598 - DNA, 1120 bp, Unknown
  derived from dsRNAs of unknown virus
gaatattctctgaagcaatataagttaatacaaaatgcagtattacgcagcgaatgataatgtacagaaacctcgtcataattatggacaatcggaaaaacgtcgacctcaatacggaattgatttaacaaagaagtatgaggctgaagaaaggatgaaaagccatgaaatggaaatgagtgagatgcgtatgatgcttgataaacttactgctggtaaggatcccattccaatgtactttgaccctaaggacctagcggcaggctcatatggagtgcatgttgataagtaccttggacggagcccatcagatggccctgctggatacattttccaaaaagtgacttattcagctggagctgtggcaagtaaaactaatgtcgcgggcatgtataaggtttcacctgaccatatgggctatatctatcacgatgccgagacaggcactgaggtgagaattaacggtgatggtgctgacctggcaggcagtgcggaccctacaccggctggaatttctggtgaggctaagcttgtgcccggtgacatgatcctgggtgcaatcctacaactagtggatacacgctcatctgataaccgcacaggattcgtaaccgcaggacttgtgtcgaacgactcagccacaccggatacatacggccccgaactggcaaatgaccctagtaactttattactgggagtgcaattagcggtggtcgcacgcactcggcaaacggtctgttggcgtgctcggtggctagtccaaaccttaacatttatagtccgactattgtggctacggctgctagtgatctatccccagcggcaatcggtgcgccaattaacgcgattaacgtttctggtttaccgggacagagtccggtcaatgtagattcgtgcttaacgtgtacgcactagttggcgcgcgccagaagacgatctcgcactatacgcaacctgacccctccttcaagatggagtgccttacgcgtcagttcgcagagcacccagtttcaatgatacattaaattatttaaagcgaaaagctacatcatgtattaagtttatacagcctcaaatgcggtatgtcaagccgggttcacattaatgagatgaaacatc

SEQ ID NO: 599 - DNA, 1008 bp, Unknown
  derived from dsRNAs of unknown virus
gtggtatgcgagcggcttcattaagaaagtcttcgtcctaccgaagggacacctgctgagcaccacgcgcggcgtcccgtcgggtgaccccctgacgtccatcattgactcgatagcgaactggctcgagataggagagtgcgtgaagatggcgaggaagaagagcttctcatccctacgagtcgccgtcggtggcgacgatacgatcattgctactaaccctaagaagaggttcaaaatggataggttctgtgagatagcctctgagaggtggggaaggactactaatccggagtcgctgatgtctggatctctcacggagggcactgccgagactacgccgaggttctatgcgacgaccttcacgaatgggcttcctcaacgtgccctcgacgacatcataaccatggatctgtgttcgatgtcgaagccgccagacgacctcgaagctaaggcgctcggctgtgtaggaatatgcggtcagcctaactataacacgcgcgccttctcattctacaaaggtttcataaagtgggttgctaacaagacggagacaatcagtgaacactgggtagacctagccttcgacatgatccactcgaagagctcgaacgtgtacagctcgcccaacgcagggagggtatcgacgccgggtgaaggaaaaccaacaatgcacgtcggccttttccctgcgaagtgtagaggcccaacgtggaattcgcttggccagcgtgagcaccctctactcgatagtgccggaaggagactgtgcgacaggatcaccgcgcagtcagtccaggtcgaccaggtgaggtggtcatgccctggtgtaacagagtacgagagcgagctggcgatccagttcgccgatgacacataaaggctcgtttaacgagccagcagtaccttgaatgctgcatatcattcaagaaattttaactacggacctagatggtacagtacacataacacgtgtgctaacaaggatgcaaagccttgtcgtagacc

SEQ ID NO: 600 - DNA, 965 bp, Unknown
  derived from dsRNAs of unknown virus
gaatattatacagtatagtgaaaattgtttatttgcatgtgacgttaagcttgacatggttcttgatgatgatgttgatcatatcgaacttaattcggaatgggaggctacagaaggtgttcttcagcgccttaaacatagctgttttgctatgcaccttctgtataggcgtcgttttctggaagcaaagcgtaagcttgcttactacgatgtccctattattgtactttccgctatgaacagcgtacttatcgctggtggaaaagactttatccctgcccagatactacaaattatgacttgcttgctagccgttgcggttggcataattcaagcaatcaaaaactacttcaaaattgatgaaaatagagaaagttgtttggtatcatataaagatttatttaaattattctgcgaaatttcattgctattggatcaaccacgatactctaggggtatggaacctcgaaagtatactattgacaagggtaatgaatatcaaacaataatgaataaatcaataatacttgacgataatcgatctaaaaggaatccaatatatgaggataacaccccctatattgcgcatagaagtggaatatctcaacttttccatgacgttccaaatagtgaaggctctgaaaatgagttccggctatttgggaggaggaagaagaaagaaagcataaaaactactgaaagtatgactgacttacagaggtctccatcattactacctgaattagagataattgaggaaaagattgagccaccaataactgaagcagcggaaacacaaacaacagcagttggtatcttcatacgagatgacaatgaaattaaatcaggatctgagtcagattaatgtgatgtgaatgaaacgggagcgatgtcgacgtaaccgaatcactatgttatgccatgataaaacatgcataatatcatgttgctgtgtatgaaacatc

SEQ ID NO: 601 - DNA, 926 bp, Unknown
  derived from dsRNAs of unknown virus
caataccctgaagatgaatcgtacatactgcggtcggatcctttgctcaaaaacaaattcatcacgatgatacacatgcctaatgtcgagatgggatacttctctaatcgactaccgcagatacatgcgtgggcgtcgacgaaatacgaatgggctaagcaacgcgccatctacggcacagatgtcaccagctatgctctcgcgcacttcgcattttacaactgtgagaacttactgccgacgcagtttccagtaggtaaggatgctaatgacgtgaatgtgcgtgcgagggttgcaggcgtgctcaaggataaggtgccgttttgcttggatttcgaggatttcaacagtcaacacagtgtcagttctatggcagcagtcgtagacgcgtactatacagtgttcgggcagagcatgagtccggagcaaagagaagccatactgtggacaagaaactcaattgtgcatcagacgattcacgataatgtcggactcaagcaaatatacacggcaaagggtactttactgtccggctggaggctcacaacattcatgaacagtgtactcaattacatctatacgaggctgctaatggagcagcacaacaaggacaaatcaagtctgcacaatggtgacgatgtactgataggtaccagaaatctcgcttcagtccaggtctgcaggaggaatgcacgcaagtacaacgtgaggatgcaaagctcgaaatgtgcttacggtgctatagccgaattcttacgcatcgaccaccgacgcggcagtaagggtcagtatctatccagggccgtatcgacaatggtgcactctaggattgagagtaagccctcaaccgatgcgagggacctcatttccgccatggagatgaggttccaagacgcaaaagcgcgcggcatgccagacaggcagat

SEQ ID NO: 602 - DNA, 886 bp, Unknown
  derived from dsRNAs of unknown virus
gaatattcttacgtaagctacaggccatgttttcatttcatcgacagagtgttaacatgcctgaaagacagcgatcggtgttgccctccgatcgattgtctattgaagaaaagtttgaagtagttgactcgttaacaatacgaattaacaaaaacgagtcgatggtggcgcaaataaatattggaaaagacgaaaatggagagacgtcagtatacatgatgaacgtaaacgtgccgtgggataatccaaacccagatgtacacgtaacttacaatcgtgtagcaaatgatgcaatcaacccaaattctccaacaatatcaaattctgagcatgataactcattatcggcggcattggcgtcctatgaaaaggatttggtacatgagataacatcgaaaaatacacaacaaaccataaataagggcgtattcgatgatgctcttaaagcgctacctaatatcaaaacgtctgcagagagttctgatgttgatgaagcttcgctatactcatatgagaagctagatgatctgccaaaattcatgtcaatatcaccaattggtaaaaagtatcatctaagactaaagaaggatggtggaatactttgtgacttaaagagtgtaacacaaaagcccacaaagcgtaatgtctatgtcataagtgaaaaagatacaacgcgtagagatggtattaatagctcaaaacttacactcatactgtcaaaaaccaagccaaaacgtcatattgacgtgcgcgatctaccaattggggtggatttatggttaaacataaaagacggtattgagtatgaggtaatgaaacaaattcgtgaattactagtcaacttcttcaacttctaatcgaatacagcgtacgtacgatgaacatc

SEQ ID NO: 603 - DNA, 843 bp, Unknown
  derived from dsRNAs of unknown virus
gaataattttggaaccgatataaattgcataatatacaactcatgccaccaaaaagaacaagtatgaagagtcaggctgaatttgacattcagtggcaagcaggtgaagttgtactagaacgagttaagcattcgtgttataaaactcatttaatgtataggcaacgttacctgttatcaagagctagattaatgtattatgatgtaccaataatagtcttatcaagtgtgaatagcgtattcatcgcaggtggaagtaacttcctccgagaggatatagttaacataacaacttgtatgttagcgttaactgttggaataattcaagcattgaaaacattcttcaaagtagatgataatcgtgaaaactgcttaatgacatataaagatctatttagattgttttgtgagttatcaattatacttgatcaaccaagaatcacacgtggagtcgacccacaaaaattcatggctgacaaaaatagtgagtacaaagaaatcatgaatagagcaatcgtattagaagatccaaaatcgaaacagaatccaatttatctcgatcttcatccattcagaaagcctgataataacgtttggttcgatggttcagacatatcaccaaacgaaaggcaaactagaatagaaatgaatcgagcgcttacatttaacgatgacattccgacaaatatagatgttggtctacctctaacgcaaggagactcatataatgttacaaatcgagatgacatcgatgctgtatatattgacaccgccaatgcaactggcgatgatgtatcggagattgtggaagcatgatctcttagggtccagaagggaaacgtc

SEQ ID NO: 604 - DNA, 808 bp, Unknown
  derived from dsRNAs of unknown virus
caggatgggcattgcctcatcaatgaatcgtttctaccatcacaacgtggtatttaactctgattggaaaagttttgatcaaactattcctacgcaggttattagtacatcctttcatattttgaaagaatgttttccagttgactcattctctgagagggatgagcagatctgggacctaataaggttgtacttttgtacatgcccaattattgcacctaacggtgaccgatattctcggcggcgtaaaggaattccttcgggtagtttctttaccagtttagttggtagtataagtaacattttgttacttacttatttgacactgttacaaggtgtaaacagtgatcttatggtcttaggtgacgatggcgttataggtacaggttaccctgtgaaaatatcaagacttaagctggacgctaaaaagtctttctctatgacactcgaaatctcaaaaccaatttatgataaagagttcaccttcttgaaacataattggtacggtgctcgcgcacaaagacctttggctgaaacagctcaaaggcttaaatatcctgaacgttataaggacgatctaaataggtcagacttaattgcttcactttacggtgataactttaagttatggagctatttccctaataatgtcaagcgtaacctccttcgatggagaggcgatgatctttcaggattgatcccgtgggacaaacgtgcgttgaaacgtgctactgggtatactattacactttagtacagcactatagggcgtgtaggccttgattcacctcgtattattctacactaa

SEQ ID NO: 605 - DNA, 629 bp, Unknown
  derived from dsRNAs of unknown virus
gcagacagattggtcatcaacgggcggttccctgtggagaatcgaagtccttctttcctatccaattacttcctatccaattactttatgagtagaatgggtcaggtaatgcctgttaagctgacggaggatatgtaccagggactagcgtatcctgagcgtaattttgaattaaacggggatggatcagtaaattatgagtgggaacttggtagggtttctggatattatttagtgtactactggaattatgatgcgagggacgtcatagcggcgtatcactcgtacctcatagaccgaataaggagcgagggtcgactaattgagatgactaatcttgatgaacaccttaggaaacttctcgacattccactcagcgcctttctactggagtggtccgtcaggctccccagagtatcagaaattattcagttatatcaggagggagaaatcatcaacttttccgatcaaccttcgtcagggcgcactgccggggaccccatggcgcgggcaatccctagggcagtggtctttgacgacggtgggtagcgatcagcaggcaaaccaaacggggcacgaatgatgaattggggaactcatctgcagtgtggtaaaaatggtcaccccgg

SEQ ID NO: 606 - DNA, 3270 bp, Unknown
  derived from dsRNAs of unknown virus
taacacattcaggtgtgagcgtgaaacgtcatacacgtgtaagtccacggcgaaggcccgtgtgtatagcttactgtatgacgagtcgcgcgactgcttttcagggattaccttccggggagaattgggatgactctggattgcttgctgcctttaaccatgatttcagccaaaagatcaaggccttctcaactctgcagaagattcttggcagtccggcggttgaaaaatggtatgaagagtacaagcaagcacgtgctgtgtcgcttgcgctgccctcccagtggcagacactagggatgaagccggaacattgggaggctcatgtagagtccaactccaaacggaaggcggcgagagccaaacacagcaccacagtcaatgagatatcggcgaagtatcagaaacaaatccgggatgcggaattgaacctagaatcggaactcgcggcgacggctaaccccatcaccgcagtgatcgagctaggttacaatgacctcccagtttctgacatcgttgctatcgaagaagcgcccgatgacactgctcgcgcagcaatgctcaagtcaaaacttgacgcactgcggcggacagcaatcggggcgctgccctgaggacccccaagggtcccgcctcgaagcgtattcgcgtgcgctaagaggaacggttcaatgcgcggtgcgctgcccgtgttgcagagacaacacgtgatcaagggtgttaggaagatgatcaaggcggcaaagaagttaaaaggggcgtataagcatatggatggtgtcttcagcgatgatagtgaagacgccctaaaatgctcactacgctacaggatagaaatactcatgtcctttcaagtagagcttgcagcgcgagtcccggacggataccccgttcaggacccatacaagtaccttgaaaggaaggcaaaagcatcggacggtaaagcgaaagaggcggatgataggggcctgtcttggtttttcaagatagaggccagagctacaagatacgtagccggctcactcgccgaagcggggaacgaggaacttcttgagataaccacactgcaggctacatattattactggcttgcaagagaaatcaaagagaagcgagtcccccaaccggacgagatgcccatgaagtacaggttcagtagatggaagtcgaacggcgtccctcgcgagattagtcatacaaacaaagctacatcgtatgacgtaattaagcctcacgaggacatcaagagcatagggaaggtggagttactaattaggaaaagtaacaaggtcatacccgttactggcgaaaacgttcgatttgaatcgaggattcacaggaaggttggcacacgaccccaacgtttccataatccagtacggagcgagcagtccaggtccaggaaggatttctcggatgagctcgacgagtacgctgaccctgcgctaataatggcgcacggatgctgggacacgaacatgttagatctgaagaggtttggagggaaaaagggaggtactgcaggcacacgatcaatcatagccgcactagatagagtgggcgaattgaacctagttagaataccgacgcctgagccaggcgattgtatgcttaccgaagtacgcgagtcgagtgattcgggtgcgatggggtcaggactgggtgcgaagaaagagaaaagtgtaggtatgtttggagaagtgctgcaagagacctttgagaccctaggaaaagcgaagtatatagacgcgtcaccttacacgtgtggtggcagagagaggaggaatttgacgccaatggacggcgaggatttaagatcacgattagtcctctgcggcgacctcgtgacggcgctgataggatgtacttatgcccaaccgataactgcctcaatcatgaaagagcgtggagaagtaaggctgggactaaagcaggatgaaatgtggtacaagaggtatctcaaagaaatccacgatacagccttctcgcgagacttagatatctcacgctctgaccagagcttgtgcgaagagctgattgtgggcgcgtttgggatcctcaggtcgatgtttgacgaagatgacaagagagtggacaaccatttctttttcatgatgtcgtcggctctgtacaagagggtgatcatacctggaggtcacattgttactataaagcgacatgggcttccatcaggccacccctttacaagcctaataacatctatcgctcactggatcgcagcgcaggatatacacaagcagctaggcgtggagaattataggatggagcagagcggcgacgacgctcggtaccactatttttccgcgtgggatatgccaaaagtagacgcgtacgtatcaatggcaaaggaacgatgggggctcaccataaagcctggatcacagaccacagggaaagtgatggcgacggctgaaggtataacccccgaattcctggcggtgcgtcatatacacggttatcctacgcgcgatttagcgcgaacttgggatatctcgctcttaccgagaaggcccaggtgttcgcctacgatgcaagccatacgcatgttctacatggactcgaataatcccttcctcagacggagatggaaatcctacatagaatatttttgtaggatgaacgtcgctgcaggacggatatttgggtggtcagattcacaggagtcaaaggaggttattaatcggtatatgctaacgagagcactagaacgcccagcacgtgttgccagtggcgagatagggaggccgaggaagcagccgtgggagaaagggaagactcctgttatacagcttgtgatgaggcagaagaagaggccctctgttaagtcccggatactggaatggtaccgggagtataatggagggaatgttgatgccgtggatatcaaggacgacctgatgcggcgcagcatgaatatattgcgccacatcaggcctgctgatcatccgaactgcgaggaatggtttacctgtgagcttagcgagagtattatagcggcgtctaccgagagggatactgctactgctggaatgaagagtatcgcgctataccggagatccaatgagatttccaggagcgtgctcagaagagagatggaatttatgtgccttgtaaaggagtatggaggcggcatatacgggaggaagaatgaggtggagtgaaggatacaaattaccggacgtagagagtcaagtgacctggtctcacgacatgagatcgaaagctagcgcaatactagtacgttcaacc

SEQ ID NO: 607 - DNA, 2638 bp, Unknown
  derived from dsRNAs of unknown virus
gactttaaagacttaggttataacccatacccctttcatcgagtgtgggggacacgtactagatgcgcaagaagaaaaagtctcagcagcatgctgttgctgccgcaatcgctgccattaacaacgcggagcacggaaactcctcaaacgcgatggagtgtgaagatccaccccaagctggtcttcaactcgagccgtcgacacacatggacgtctcggacgagggcgactccctcatgtcagacagtaccaccgacagcgtgggttctgactacgtctcgtcagacgaggagggcgcccgtccgaaaacccactacatcaacgtgagtgggccgccgcacaagggcatccagtccggcaaccgacaagtatcgaccgggacgccttccacctcgtccgcccgcactatcgggtccactgtaggcaaaggccccatctcgcgcgacacacgttcccgagactgccaaaacgccaggccaacggttcgcagaaacaactggcgcgagcatcggaactcgacccctttccagcgagcgtgttcacgtgcagctggttacgacctgactccacatggaccgcccggcgccagccgtgtgtcgcctgccacaccgaacaagaagcagagatcgaaagccgccaccgaggacgcggatgaaatgcacgtcaacacaatgaaagcattggaaaagatcgtccagatgggtggcaagaacgtgcttgtggtgggctgtggacagcacgagaggcagaaaagctacctccgaatgggcgcggaaaaggtgactttcctcgactcgaacccaaaagtggtcgaacacctgcccaagaaattccacggcatggacttcggcaccgagtacgaggtcatcaagggcgacctgttcgagctggagtccctggccaagacacatgcaaagtttgatgttgtggttgcaaccaagtgcctcggtcacgccatcgcacaagccgcaaaagacgactcacccacagctcgtcatggcaacgtgaacgccaccttcctactgcgaatgttcatgcacggtgttagtgaagtcgccaagaatgcacaccacctcatcgttgaccaacttccatacgacggagaagaaggtccctggacacgcggcgacgacgtcagcaaagacgtctgggagtccatgacaagcggcgggaagtatgttgactctcacttcaagatgagtgcgttcgtggagctgtactatccgtcgctgtcctggtcaccctcctttggacagaagtcggtccacgcgcagaagtggcaccaggttatactcgaacgcataaccaagatgccgctggccggccacaagtacttcagggcgccctctgcgctgccccttgtcggaccgttcatggtgcccggagacgtcacagctgccagggaagcaagcatggacgtaaaagtcagaaacctctacttcgctctcctcaggaacgctcgtgagatgctcaccaccgacggcagaggcacgtcacacgagaagcgcccgagccttcgtggcatcgcaggccacgtgggacctggagcggtgttcgtcaaacacgatggcatccagacggtgttcacaatacgggacggatacgtgactgtattctgcgacccgtggacagtgttcacaaagcgtatagaaggaatgcccgagacaatcgagatcgccggactgatggagctgctcgaagccgtgccgctagacagccgcggagaaggtgacgcacggaaccacgggccctacccgcgcatcggcatcatcactgcaatcaccaagtacggcaacacctcctacacgaacggcacggacggtgttggctacatgcacatggagcacaggaacgcactctccgtcgccgggatcatatgccaggtgcctgcgctcaaaatgtacatcgaaggagactggctgcggatcgccatcggaaccttcttgcacttcaccagcactgacggcattgtggtcgtggatgaagggaaggaaacgtttgtgaagccctcagtccgcatgtcaatcgacgtgactgcccgcgacatcgcaggaggcatgcagaaggcggtggccgtgatgaaactgcagggtttggacatctcggaggaagccagagacatcaaggcgcgctccgccaggaggacggtccgcaccgcgtcggcagtgcgtgtggacgtggacttgcaagcgtgcttcgggccccaggcagagacgccatccttccaaaacgttttcgaggttggtctgtctgctggtggtgtcgacatcatgcgaatacgtgacgacaagagccatccgaactctcttgccacgatcgcgatgaccgccgccagatgccgccctggcgccatgaacatgtcaggcactagcacgcaaaaccttctcggcaaggtcctagaccgcgtacaagagtacaccttcaagcagcgctgcggcgcgctgctcgacgtggtggacggtcagggagtgcacatcgacattgaactcgacccttcttcgctggacgtggctacccaagctccctaaccactctgaaagcagtaatctacctaaataaaaaacaggggcggcgtataacgccagccgcccccgccaacacgccagtaacgccgacgcgttttacagttggccccccc

SEQ ID NO: 608 - DNA, 2115 bp, Unknown
  derived from dsRNAs of unknown virus
gagacatacaatgcattcctgtcttgtgttgtgcagggatgtaggccttgggcagcttcggactcgggaccctgcaacgttgctatgttcacgcctgtcgatggtggggtgtactttgtcaatcacaggagtcagctgaccacacaactggctgtctgccgggcagctctacttggaaacacaacgacacttgcgctatgtgcatgccgctatttgggtgagcgaagcatagcaattaaacacttgacagacatgctgtcggtggtatgtgcgtcaggaacgcatgagggtggggtgttggagcttaaagcaggctctggcctaccattctacagcgagctcttcccctacgcatgtgcagtcacagagacatgcccaaaccctctcgacttgatactgtcgcctgggcaaatgttagtggagggcgcaaaactatgggcagcgcagtgggcaatcatagcacacactggtggtgactgtgtgaacactgatgaagccatagactatctggcaccctatgtgaacgcagggtggaggacggcacacccccagtacatggagttgatatccgtgagcgagcactataggtgcttggaagcttttgtaagagaggaggaatgggcaaatcctcaaccttctctcgaagctggtttctacctcagggatccactgttggacactgagggaacgaagaggttcttcaaaagcattgtggtgcaagacaggacgaactgtggcacacaggctgatgatgacattgctaggctgaactcgggtgattggcccttgttggcaagtgccgggtgcccaatagtgcaagttgcaccaccagctggcaatgcgggaagaactgtgcgaccagtagtgcatggcctactaccagtcaaaagagatgcaccagaaggtcgagtggatgtgggcaaggcagtaaatgctttagtgcaggcagcgcaatgtcgcaatactgccctgcgcaacactttccagcaacacctacaagacagagaggagaaggggcctcacggagcccttgctcaagctatgatgcaggcatcaaaaaccggggaaatgcagatcatcccacggcctccgacccagattctgagtagacgagtcattgatgtgctcacccaacttggagaaacggagggagaacatgagctagaggaacacggctggactcctgattctgcgtgggagcattcgcaaggtacagcacctatggaggctgcggagctggttggacagctatacgcagcaggggccgttgatggtcctggagcagcgtggagcatgcctacccaggaaagcaagaatcaacagaatgcggtgctaaccccaacacgcttgccttcggaacaagccacggcctatgcggtggaccaccacccaacaatgttggagacgcaccccctaccgggagcaggtgtagccgctggcatgggggtgggggattcagacactagcgagccgagcctagtgactgaagactctcaaatagtgagcctagctggtactgaaagaggagattctggcaatgagcaggatcaggaaatcttggcagcagaacaagaacaggaagaagagcaagcggactctcaatacacaaaccccgcctacattagacagcatgcagaagaggtagtgggtagggttctaccacaactattgtacggtccgcaccatgggccatcacccacacaggttgtgcaaatggccgtagctgagcaggtggcagcagttgcagctcgcatcagcttgagccacgcagaacaggcagccgctgagggaatagcattaaccacactagctgagtatagactacccactgaggactatctcagggacatgttggtagataatcctactgacaccgaggacatactacttgcagctgaggaggcatggtcattagcaggcaaagtggaacaatgggctgagatgcggggtaggctacaagatagcttaacgcgcagaagtggcagaacagggggtagtgaaccaggtgccatgtagcagcggccacacgggcagcgcacacctaggcggtgcgtggcccaataaaaccttgccgtcgggtcaagacggtagacttcaggcatagccctgaaaccc

SEQ ID NO: 609 - DNA, 1934 bp, Unknown
  derived from dsRNAs of unknown virus
gttttaaatacaaaaccgtgccctcagtcaacgaaaaactgttaaaatttgaattttaaaattcaaataaaataatcataattattatcaatgaaactaattaatttcaagtcaaaccacagacgtttgacaattagtcatttccgaccgtcccccggatacagaaatataaatagatttggtatggataaccaaaacaaggacattttagacccagctcttagacgcgtcgctgaaggcgaattcgctaacgttcgaaatcgagtttctcaaaactcaccgcgaggagcaaaagtgttagaccaattaagtaaaggtgacacacaaggagcagcacaaactgctgtcgaaatgggcgcagacggagccatcaattatgcctctcgagctgcacaacgtttagctaataaagctaaaacacgtgtgaaaactaagacatctacaaaacaggaaaaaccgaaacaacctactatgacacgaaacagaaacggaaataataatggtggaggaagaggaaataaaagtggacgaggtccatctagatactctgctccgagtactagtcctagacaagatcagggatacaatccattcatagatccgccatctagttcaccaatcaaaaactcacatccagagtttaaatcattttatcacgtaccactactttcacaagagatacgcgaagatgatggtgagatagtcaattacgccaagactgcgatcacagtaatcaatacagatgtttcgaacttgttcaatatccaatctccatctctgacagcgtcagatttaaagcctcttaacaatgctaagagtcgcatttacacagaagcaaaaattcaagcgatttctaatactaatggaggaagatcagcatcagtcacattcactagcgatagattctatgagtatttacgattaggaatgtcagcgtgtgctctgattgctaacttaaatgcccttatggcatgggatccaccgtacgaagaatctaactcatgtattagatctctaagtaacaagatgtcatcatcaattccactacgtgttgcgaagggtgctttagaagaggcattagctgccttagcactacctcgcccaatgaaagagtactatcgagaactgttccagatatacaaaacctctcctattgcaggcggtactcatcatttattttgtaatcatcaaattataagagatattaaaaatcagagcgttgactttgattcaaccgttgcgcatctcgataacatatcagcgcagataaacggttcgaatttcaatgattatgctgtaattacggctcttcttaaagataagacctatttcacatatgactcaatgcgagacttgattgcgatgccggattcgccgtgttactcagcacgtcaagcaactctctttaataacacaccatggtatactacgacaaatgctactccacctatctcattacctgtattctcaggcggattagatagcaacgatacagcacaccttgtgtcagcaatgggtgttgacgaacttacctgttacgaagttgcaccagctattcaattatttggtgactcaacaactggttcaggtccagtttactttgcatttgaattcactcgagacccagatttagatcactctaaccgattctggtttaaagactcgaatagtccattagaaatagaacttcataatgtgattcaatcctctgatgatcttctagatttcagagttacaccacaagctactagtattgatgcgtcgtctcaagactacaatccaatagttgttgctaaaggtgaaaacgttcgtctataccaagcttcaaaacaacctttgattgaagctactgtcaacatgatgtacaaaacgatggatatatcgtcaagtaaattaatgtaaaacgggggaggatatacttagtatatcttccc

SEQ ID NO: 610 - DNA, 1704 bp, Unknown
  derived from dsRNAs of unknown virus
ggggagggactggaagagcacttcgggaagtacatccacactccgctttccaaaagccatcagggcccagacgcgtgggtcgcttgggtcgagaagatgcgaactggggcctacgttccagtaccgcttgaccaaacggagttcgaccatgtgccgggaccgactgccttgtgggctgtgctcgacttcatcatggactacgctggagctgaggacctagagcggaaggaggtagccaaggccttgaagacgagcatgttggctggcacggtgcaggtcgaggagcagtaccttgcccacaagcgaggaatcctttcgggctgggcttggacggcgctggctgacacgatcctcaacgcagctgagtcggaagggatccactggatgctaggcattccgaaggggtcttggaacgatcaagcgttccaaggtgacgacacgctgctgttcgagcgttcatggggcgaggcctactccgttgtcgaggagtaccagaggtcaggctttccggtcaaccccaagaagttctacctcgataccgaaagggtggagttcttgaggtacgagatcacgaagaacggacgtctcggatacccgatacgtgtggtcccgagcttgtgccacgctaacgcatggacaagtggtaagcacggagacccgtctgccttgtgcaacacctggtcaacagcctttggcagaggcatggaccgcgccaagtgctggagccacatggtggcagatgtcggcgggatgacgcgcgctcccagggagcacatcgtccagtggctgcacacgcctaccacctacggaggctacgggtacatcagcggacgtgatggtgggatctcgcggacgttccgccgcgtcaaggaagtcggtagggatgagtggctgcgaaccgacaagtacgaggactggacggaaccgaaagccaactgggatgatcttggaccattggggagggttcagctacaacgcaagggggaggcgttcaagttgagcaagaacggagtgcggggactagccggtttgctagtacccaagaaggcagaaggatccaccatgacggttttcgaggaggtggacagggacagcttgcagggatcaggaatgggttcacgaggctgggggatgcctggcgacatcctagctccgggctatggcaggacgctgcctagtccgaggtacaagatggatgcgatgatcgcgagagcagcgctgacgagcgttgatgatgaggaggaggctctaggctacctagagcccgacgaattggtcagggcgaggaactaccgtgtagaactaccacgcaggacgtggtgggaatggatgaagggaacgctcgagaccgtgtccgtcaattggttcggtgcagctggcgacgtgaggggacacgttgctaagcaagtggcgagcctaggactgctgccttttggcaaagttcgtgtgggatcgatggtccgtagaaggtttgctcttgaacgagcgggcttgaggatagcgacgacctacatgatgcttggcccgtaaaccgctggctttggcaagcctaccagctctagcaagcttcaagggaagtacagacgaaccactaggtaacgagtactgactaaggggtcaagccactagagcgcgcgtaatccttggcagggaaaaacgaggggcaggccagtacggtgacttccacctactggttcgtttttt

SEQ ID NO: 611 - DNA, 1657 bp, Unknown
  derived from dsRNAs of unknown virus
gtaaaataaaataaatgaaattgacgtaatcattcctaaattacctgagcgtggcttaaatcgtcgcactttgtactggtattttaccagcctgaaagcgcaccctcaaaacattttaaatctaaatttatatgaagttaactctccgccaagtatataatgagcttaatatgtcatacgacgcactccaaaggcttgcccgactgttagataggactagccgtggttcagatgaagtatacctttctccgattggcaacaacactgagccggaagttgttctccaaggttgggacaatattttcaagtcaaatctctcttctatgaataaaactttactcgatttagaagaaggaaatcgttccaaatacggaccaagatctatcgcaatcccctggtcggaacgtcaatctggattagatgatgccttttctgatgacaaaggaaggaagattgaatccaatctaccagattcaggtaggcttagacctataacgcgcaatagtgctgtcaagtatataaagttacaaacatcggcaggactacccactatgttaaagaaagggttagttttaaatgagactttagatcgcgactgggtacatgttgacccctacgtaccatgcgtaccatttactaggacacaggatcaaaagaaaactagattagtttggggttatcctcttcaatatatcttaaacgaaatgcagttttacagacctattcttgaatatcagagtaaattaccatggagagcagccttaagaagcgcagatgatactgatctatcagttacgtcacttatcaaccatgctcgtagtacaggaaaagttttaatgagtattgacttttctaattatgacaattctgttaagaaatctttacaggaatatgcttttaatgactatttccctagcctgtttcaacgagaatttaaacaccttatcgttagacatggagatcgttttaataatataccgattattacacctgaagaggtacgaactggtagtcatggcataccatctggttcagcttacacgaatgaagtaggatcagttgtgcagtatggaatatctcaaacatttaatgaggttctcaatttcagtcaaattcaaggtgatgacggtgcctatgccactttggacccagaagggcttaaagaccatttccgttcatatggactggaagtcaatgatgaaaagtcttacatatcagatgattatattgtatatttacaaaatttatatcatactgactatattaaagacggtttaattcgtggaatttatcctttgtaccgagctttactgaggattgtctatcaagagagattcaatgacttttctgaggatgatattagtggtaaagattactatgcgatacgtactctttcgatacttgaaaattgtaaagcacatcctttatttaaagaattcgtcaagtatattgttggacttgataagtacaacttagactttagcgaccaaggcctttcatcatatattaagatgcgtgaaaagcaagatggtaaagacgttaggttcacggagtataagagaggagacgggtttggtattaaatcattcgaatcttataaacttgctagagagcttattgtttaattaatttcggtgtaacacttttgtgctacatc

SEQ ID NO: 612 - DNA, 1500 bp, Unknown
  derived from dsRNAs of unknown virus
gaatattattgaacattgtaacattgttaggtaaataatgagcagaaatttagttaagcgttctataacagatggtggtaccaaattctcaactgcagattcgcgtaatgtaaagcattcggcgcctacttcgtctggcctgttatcaaaagttgcaaaagaagaaaagcgcatctcaaaagaggcggaaaaagaaaggcaacggatcgaaagagagagacggatacttgaagaggagaaaaggaagcgtgaactcgaagagagggagagaaaacgcaaactcgaagaggaggagagagaacgtgaagagcttgaggcatcagaggcagcagccgcggctgagcaggcagagcttgacgccatcgcagaggctaataatccaattgacgatggcgtggaagcggacgctgacgggactacatcaacgaatgataatgtttcgacttcagataagttgaacccgtttagcaaagcttccagagaaggaatacacgaatttcataaggatttattctcaggtggcggagctacaaactttcaggatgccatgacgtactatgagggtatagtttataagcttggaggtgttctcactattcctggaatgcctacggcggcaggagcacatcttgcaatgttgggagcagatttatcgcatgaactacgtacagccagcgcagatgattggaacccaactacagataaccgaacaaaagatgagaagaacttcaacacacggctaggtgacagaatcctacgtactatggacgtagttggcgctataatggatggaacaccaggagaaatatcagggatccccggtttcgacaaagtgtcacaagatgacgataatcaaggcttctttggaggcgtaggaaggagatttgaaacggtcggaaatagatttgccactgactttacgagcatggagggcggtaaattcggtttccaggcgctttctaaatttgaaagtgagtcacaaagagtaaaggacctacatggtattcgtgtaatcgaaagtgatcgatattatactgtaatgtatcatccctcaagtgacgttacatacatagagtggaagccaactgaggatatccgtaatataaaacaacgtaataaaatgtctagcgtgggacgtgaatggagtgaggacttcgtggcggcaatgggcgtcaaaataccagcatggtcaaagcgagtaaaatacataaaggataaatacggaatggaaagcgaatcagtaaaacattatggatactctcgtggagctggtatagccacacatatgggtggccttgggtatggaaccggttacttttcatcatacatgccagataagaaatctaaatccaagcttagtggtgatcgattacatgatcttttaattaacccaatttcatacggcctcatgttgaggaatgtgctaagtaacagctgactcattttacttgaacgtgacgttctagccgttacgatttatgctgttcagtatgaaacatc

SEQ ID NO: 613 - DNA, 1395 bp, Unknown
  derived from dsRNAs of unknown virus
ggtcaagaagacgtacaaactctaactgcggaacaacgtaagttcaaaggaaagtatgagtggtggtgcaccaaacactgcctccagcgcatctgcctcctcgggtaacgccagcatcaacgtcagccccgccgctgaaatgctcaacactctcgtcgcacgcaacttaacggcgagcgagatgcttgtgcactcgtccttcacgaaaggcatcatggctctcaccagaaacggtttgaccgaacacgccatccacaccgcaatccgcgagatcatcacgaacgatcgttctcgcatcgcccagcgcgtgaccatgcccaacgacaagggcggtcgcggtgtcaacctgtcattcccagcggcatgcagcatctcgatgttcatgaacctggacacgaagcacggaagcgggctcgttgctgccttcaccgccctggccgtcgagtggggcatcatcaacgaaggtgccgaactcgctcaagacgacctccgtcggatgcgggctgccaacgagaacgccatgtacgacgccatggtcgcccaggccgatgcgtacaacgctaccgcccaagccgtcaagttcaacgtcactcgcatctccgttgccgatggagagaccatggcatctgagctcgacgccatctcagcgcaataccatcaattgccaggcagtgtccactcggccacagtcaaccacaggatcgaaaagtgccctgtcaccggccagcaggtgtacatcgcctacatcggtccgctcgaagccacccaccgcaacctcaaggtggccaagaagaaagtgaaaatcgcctatcacaattcaagccttggacagagcactgcaggtgactaacgccaaaactcatatctactagctaccgctgccacgcgacacagcagcgttagcgtgaacaggattcgatacacataagtctgacactatccacacgtctcgtctgtgtgtgtgcgtcccgactagtagtccacaaggtgtcatgacgccactgcagggcaacgagcaatccgtgccgcgcgatttaattcaaataaatcacgttttcacggagccaaccgcccctgtgtagcgccatagtacaccatgaactgccagttgtgactcatacacccagactcgtcgtcactggatggcatgtcgacatgttcggccacggcacgaccgaacactgtccacacgccttaatgcttgccaaccttctgactcgtctcttgtctttctcttctacattctctattcccgaccacaaaatttaaaacgcggcgagctcgtgcactgctgtttgacattcgtatgcccttgcatgcgagtgccacgctaatttcagcacccacgagcaagcgcaccgcaccatgcgtcccgcaccttcgaaagaaggcccc

SEQ ID NO: 614 - DNA, 781 bp, Unknown
  derived from dsRNAs of unknown virus
cgaacttttgagtaatcttgagtttgtccccattcgcgacaaagtattttcggaacataatgcattctttcgtagaaaacaattcagcgaacttattagtatcaacaatgggcgacgcgccaaaggtggctacagacgccggggccctagttgggctcggagcgatcctagttaccgaagggtgcactagcgagacagaacactgcgggctttggccggtatcctataccgccttagcttccggtgcctgttgcagcgtgcagccagtcgtcggagatgacagacataccgcaggggagagcaccatgctcctccagctttgtgatgtcttccgtcttacactgcacttgcaaacaggatgtaccgccaacgcacgcccagtgactgggggtgcgaccggcggtcttggtatgtctggcccctgctgccttgatggaagagtgggacaggatcaattggtgctttcgcacaatgttgtgactgtaatgctcggacaatttcagccgcatcagttttgcttgtcatgcctgttttataacacacatggcaatgcatttaaaactcccctcccgtcaaaaggagatgcgctggagctgtgctcaccaaacatgtgtgataaaacacatgtcttggcactcgtgtcatctaactcagttgatgtcataagtgatgatgccatgtgtagcaaatacgggctgccgctgcaggtttgcagaggtggcctggtgtgacccgtccgcagggttaatgcggaagacttcaggacacacccctgaaaccc

SEQ ID NO: 615 - DNA, 909 bp, Unknown
  derived from dsRNAs of unknown virus
gaatattgaataacgaaagtgaacgaactgccgattttaattataaatcaaatcaaactatgacggacgcaaattccctaaaagataatatcgaccgcgttagaaaatggaaggctgaagaatataccgatgcctcatctatcgcaacaggaatcgaacgcgctcgggccgtaatatccaaccttttgagtgggatcacacccgagaacgtggaggggttaacgtgggccgtaggtgaaattggaactactataacagaagtgcgaaaagcagtaatgcagtgctcaatataccaggcttcatccgccggtgagcataccgccatggcaataatatctgatgatattttcacagctctatggcaactgaacaacgacttactcaacgagcgattaaaaatgctggatacacgcaggcattacatgcgcagacgtgagaccagaaacgttgtatgtgctgcggtggaaacgtctttcatgtttacaatgtttctggcaaattatgaagtattagttaacgccacatcagatgttgtacgtggtgccgcgaactggcaccaccacatggcattaatgtttgatcagctatctgccgcacaaacatacgatccagagatgttgaatgagggtgaagaagccctgcaagcaccatcagacattgaacttgatgatatgcctaacttaataaccataaactcagaagaaaccgatccacttagtaacatcgaagaacttgaagtcacaagtgaattgagtgattctagccaagggacaagagctcagacagttaatgagattgtaactgaacttacaaaagttaagagtccaattgacgtataatagtgattttgatgcatttctattccaggggtgtttcccaacttgtcaatttcgttatacatgtaacatc

SEQ ID NO: 616 - DNA, 909 bp, Unknown
  derived from dsRNAs of unknown virus
gaatattgaataacgaaagtgaacgaactgccgattttaattataagtcaagtcaaattatgacggccacaaattccctaaatgattacgttgaacgtgttagaaaatggaaagctgaggagtataccgacgcatccactatcgcgacaggaatcgaacgcgctcgaagtgtaatatccgacctaatgagtggggtcacgcccgagaacgttgaggggttaacgtgggccgttggtgaaattggaactaccgtgaccgaagtacgtaaagccgtgatgcagtgttctatctaccaagctgcttctgctactgagcatgcggctatggcagtgatatcagatgagattttcacagcgctatggcatttaaacaacgatttactaagtgagcgactcaaaatgcttgatacacgtagaatgtacatgcgtaggcgtgaaactcgtaatatcactagcgccgctgtagagacgtcattcatgtttacgatgttcctaacgaactacgaagtgcttgttaacgcaactagtgatgtagtgcgaggcgctgcaaactggcatcatcacatggcactaatgttcgatcaattgaccgcagcgcagcaatatgatccggaaatgctagatgatggtgacggaattttccctgccccattagatattgataatgatgatatgccaaaactggaaaccattcaatctgatgaaactgatccattaactgtgtttgatgatgttgaggtgactagtgaattgagtgattcaagcaacggaattagggcgcaaaccgtaaacgagatagtaaccgaattaacaaaagttaaaagtccaattgacgtataatagaatttgatacatattttaattccaggggtgtctcccaacttgtcacttacgttatacatgtaacatc

SEQ ID NO: 617 - DNA, 13939 bp, Unknown
  derived from dsRNAs of unknown virus
gggggggtacgtgttcacttctatgagtgattcacgggttgtttcacaaccatgtggttttaatgcccaagtacgggctgattgcattcctctctgtatgtagatttaagcatccttgcccacgctgagagagagaaactcggtgctggctggtgagtgaagctcccggattgggatgtccaaggcaagtaggggctttggacgcaaaggtcgcaacatccagctttgcctgagccgacactctcctgtaaggtcaaggatgatcacggtacgtgaatatgggacaatcgagccctttaatgagggtacacgtgccaagactctctggccactggaaagacagttacaatcaacatgtgtccggcgggactgtacgcagaacccatgagccgaggatcggccgtccctggtgaaaaccgaccagacttgggcgtgacggtgggagacaacaatcatctgccggagaggtgcctggcattggaaggcatagggcatgagagcatagagggtttattcgagcgtttagcagcagtcgagaaaatagctgatagagagatccatctaaatgagaaaagacgcctctccaacctgagagcttttagggtaattgctcatagaccagcactacttcttggaaccatgagattgatcctggaacgccgcctgatgaggagacgcgcatgcgcactcttgattgcgaggtcaaccttcggaaacgatgtatacgggcctgctcaccgtacctggaaccgccttctccaaggagcgtggtccccgggtgacctagcagcagaagtggagcacagtctggtaatcgctggaagctgccgggatttcagatttaagtatggaccaatcagtgaggacaaagggactttgaatttcgtgttcatcactcgaaattttggccaaatcggtctatactcgcggttcacgccttttggcagggggtttgaaggtcgcgtgcctgataggcatgaagaaatgatcactgacccgaaccttctttatggcgagggacgcgtgcctgaaagttcaggtgggcacctggcgacttttgtcaagaaccggaactggcaccaatggtcatggaaatccttcaaggaacttcatcaggattagcccaaacacccattccttgcaaattctgagagcgcaaacaccacgactccacccatgtgtaatcgacctgagcgtaacatgtttctaggagcacaagggcacacacattaaagagcagttgttgcagataataggtagattcaagacgtgaggcgagatctttggagtgttttgtagattgcacgaagacagtatgtagattgaacctgcgggtcattaattttagactgagattcacccacctgaaatttagataccatgtttggatcagactaggatgatgcgtgaaccctctcgcccccacgggtgctctgacaggccataacctcgcctaaacagggtggtaccctggtgtggctcatgtcgctaacgtaggaaccggccgcatacagtggggcagtcggaccgaacgtgccatctcaagttgagatggtggagagactgaaagcgaggcagaacagctcttatagtgttccgtggaaacagtccagccgtgcagcatcatcaaggccctaaccaggctgaaacacggaggcgtcccatgggggatcaaaacaaaagcgcgaagcaatgtgaagatcggaaagtagccggaagtcagagtggatcctctgatgtgaaggtgaggccgacacctggtcacttactctgccgccaagcagagggctcgtcacgccagcatctggtacagatgaagagggacgagttttacggcaccaaacaagcggagcctcggattgagccgaggcaggggaatttcttggaggttcccaaatttaccacgaccactacagttctggggccatggattccggaaaaccaacaaggaaccattgttgagacgaggcatggctatgtaatgtatgtgacccacaaggcggcactggccgctgtgtcctcaggaaaagcggggtttcaagtgtgtggttccatcagtgattttgcgattgaagacctggatgagacccagaagcccttcgtggtagtagaatttagagaagtaggaccgaagcacttccccgtatacgttattgtggatcggcgtgggagccatttggcaaacgccattggtcggtgggtgccgttgcccaagacttggatggatttcagcgcggccacttttgacttgtacaataacaggcgcaacttaatttttgaaggcttgcttgacattccactccttttctcaaacggtagttttgccaacgtcgtgttgagtttaaatttaggggaacgcacgcccgtggacggcatgcagacactccccaaagagatggtaggtgagatctgccatctggcacttggtgggttgcgttatcacgaattcctcaccatgttcgggggttacgatcaagagagctctctcttagaagctttctctaggaatgtcagaaataaagcccaaccgaactcgtgtctagtcgtggggccgtctggcgccggcaaatcgactttcgtcaagagggccggcaacccgaggatcctagacggtgacaagtttgtaggttggtttcattcagatccggagctgccccatgatagggatttgtcagactgtggcttggttcggaggtatcgactaggatgggctctggcgacgacccgaattgccgtccttgttcactccgagaacaaagattgcttggacctatgggacgctgtctgccttaagaagtgtttctataaacccaccttcctacattatgtggcaacgagccagagcctgggcgccacaccctaccaaaagggagcccttaggcgttatgatgcgatgcgacgttgtgttgaggcctatggctggatggaagtcaacacaagcaaggatgttgaaagttggttggcttcggagggttatcccacagtaaattccagccacgaaaacccgagccccccttgctcacccccaagttgggatgaagaagcaatgacggatggctccaaaagaaaaccttttggcttctttgatagactgaacacgggcgagacctgtgaccaagaagagatgcctgcttttgagagccttttctcagatgctgaaggtcatttcgcgatgttaggcgggctccatcaagatgtggtgactgctagacgtgaagccgaagaggctgcggccaccctgctcgcggagcgggctgagaggtatgaacttcaagctgcttgcgaacgggctaagtccgaatgctccgcccagagtctccaacttaccaatgcacgagcctcaatggccgagctagagaaagaacgggcagacatagggactaagcttgacatagtgctcctcgatcagcaggaaaccaccaggaagcttgaagaacttggagtcgtcacacctgatgcaaagctcacctcagttgtggacgtccttcgggacaccttttccagccatagggcagaaatcaaggaactcggggcaaaacagaagaccaccctcagagaggtggaacagaagcttgctgattcagagcgccgcgcctcggaagctcataaagagtttgagaaatccaatcaggcgctagccactcttagtgcaactgcgagcgctgaaaagggtggctgtctcaaccaaatcgcggaactccgaagtgcatgcgaagtcgctcgtgttaaggcgggaaccgcagacacgaacctcatggaggcacaaaggaagttggaggccgccaagacggccttcggaggccttggcatcgagctagatggggtgcctccaccagaatggtctctccagattgacgccttcctcgccaagagcaaagaacaacaagcgcttgaaaaggaaaggttgttggaacaaaatgaaacagccaaggagacagcgtttcgtctagaagccacaatccgtcagaaggacacggccatcaacgaggcccggttagaggccaaaaggctggcaatagaagcgaacaaaagcaacttagaccgccaacatttggtcgaacaaattcgtctccaacgtgcagagttggagaaacaaccaaggagagcagaagccatgtccacgtatgcaaacgagttgaccgcgcaaataaggcgccaggaaggccaaatttcggagctcacgaaccatatacggtctgccaacatctcagtgtcggcgcccatgaggccgcgtgagacggttcatcccgagagacgaagcgggcatcagggcttgcagcagttctctgacggcgatgagaaagaatccggggagaaattggtctggttcctcgggaacgtagtcataggtatatcggctggcgtgttggaggaattgatccgagtgtatgacaccaccccttttcgcctcgctacacctacagtactggcgatgctcgaaatgggcatgtgggctgtaaattctgagtacaaagctgtcgcttatgcggctgctgggcattccttcctcgcattgttggcccattttgcttgggtgtgggtctcggttgtgacccacgtcatcgtcaacgtgctcgccatgattttacaggtcaatttcctcagcacacccttgtactggcctgccccgtacctcctggcgaacccgctgttcacaatcccgagtgcagtggccaactggttgggtgagctcttagcgcgtacacgcggtgcgaaaaggagatattcgagaagggtttctctcataaacaccgctgcaatccgcggcttgcagaagagccagaaggtgggttattcagttgggaaagctgcagctgaagagagagaggtgttgacaccaggagtcattcctctcaaagaccatctggtcccccctcggtcgggagctccagatcaaaacacgagtcggaaggaggcttttcacccgagagagggacatttcatttcgacgatctacaactattgcggcgagatgacgggggtcaccgaagaacgtgtagcatgctccaaatcattccgcataaaattactttcatttgagcgtcgcttggatgaaagtgcagggcaagcatccctgtcacgttacgaggcttaccttcagaaaatccgagacggaggaggattagcaatgacccccatcgccttagcagcagtagcaaggtgtggccactcctgttcttacaatgctggtgccgagagtgtccacaaggacctctcaactctcggggaagatggccacttttcctgggcatcgagcaggatccatcgtcagaatgaggagcactacggtatcagatgtggaatccaccactcttggttaccccaccaatggagccctgaagcaatggcaacgatattcggcgggggccaggtctcaccggttatcctcgaaatggccttcgaagtgggactcgaactcaaccgtcttctacgggagaccgtgaaggaaggggaattgatcgcagtcacatccgctgactcaaagtatttgaaggcaaaacaccctcggtggcaaggcatggcatacaccctgcttctggtacctgatgatgacacaatgcagcacgtcaagtccgacgatccgaaattgatcatattaaaagtgccggtgtacgtttcaatgcgttctctggcccactggcggggcctgataccacagttggcacgaccaggctacgatttcatggttttcaacgctgatgtggggcatctctggtttgtggcccgaccgctcatagaaaaatacagaaaagactgcaacaagttttcagtctgttgttgggcgcatctccctatcaacatgtcctgcttcttttggaaagggggcgacactacaggactcgccgggaacctttatgccttcgaagcccttggtttcgtatatgggagtgacgaaatagtgcatctcgcatttggtgatgtcgtggcagtgtacaacctccctggacaaagaggcgcgctcctcggaagaagccaagaggttgatctccctgtaaagactcatgccataattacggatggcaccaaggaaatccgcatcgacagcaaccggtacgaccgattcctgcaaaacgttttggctaatcaggatctggctagtttggctccaccgccttatgacccaaaagttgtcagtttgaagacgccactcggttctgagaatgggtcactcgctgtgctgactgctgtcgaatacgaccaattggcatggccggcaggaaacctatatgacgccgggaataagagcctgcaagagctcgtcggcccagttttcttgttctgttttggcacagaaggagatgtgcgcccggtggtgtacgggggttcagtactagcaagctatggctttcaggtcatcgtggtgaagctacttgacgagaccgaagctttgactgtactagaggcagcagagaacagcaactctgtagaatcaataccagcttacatgcgagccatgaggcgggtgagttcgtgtgatgctgtgcacttttgttccaccaacctcagttcggtcaatgccatcaggtattcattgtctccgccacctgatgttgtcttcccaaccagggccggaataggccccgtcttggattgggtcaaaaccctttttgatagcttacaagaagccgacttctttgtgtcctgctacagaagagacaaccacgttccacgcggcacaggagaaggacagaaagtcaccaccaagaaaaacttgggtgtttatgaagtcgggctgcggctcggttcaagcaatacggagattccaagagaatatcgagcggtcaggatcatcccacggggagatgatctcaaagagttcccaaaatacaaaactgtcatatgccatggtggagcaggcaccgtccagaccgcagcagcgtgtgggtgccgcgtgcttgtaattagtgacaaggtggatagacgttatcgtctcaaaactgacgccggtcgtggtgttgatgcgtccggggacgaaaccaggtggttgctccctctgatgctgattgatcctcgtttgtttagaatgtacacgtgggcggcctgtagcaggcccggaggtccgttcttctacacgtggcggatggcgaaagcatggtttgctggtctctgtttcgcctggaaaatgcaagcattgatcacaaccttcaacataatttacgcggtttgggtggcagctgggctgcttgtacggtctaactggggttttgaccccacttccacgctgcttttgtgcctgatgccccaacactggggtcatgcagcacgttggagtcttgtttcactgagttacctcctgctgcatgctttgagcaagcaattaggagtgcactggctctgggctgtaattggtccaacatggcgcgccttaggagtcataaacaacaagagcttcattccttgcgtaagcattttcgggctgccgggcattctggtgacacaaattgtgtcctggctgggcccgcgactcctcattggcatccagatagtcagttgcacattcctacgagcgtggaggacccgggatttggttggggcgccgcatggcatatacattgaattttggtacacccgaaacctaggtctgttcccaatcatacacggtaggctgatagacaagaaacgcggacttgtgtacgaagggcggcacgtcgcagatgccaatcttggcgccaagtttgaggcagtgaggggaaaatatgatgactcgtgcgaaagggataaaacaagagccagtttcttgttcgccaccagcgtcacacctgaacgtttcgacagcgccaaattagaaaggcacccgtatcaaccttggtggaattgcatagccattctcatccatttctttacagagagggagttcaccgagcttggatggctacccctcttggtctgcatggggatgatgatttatgcaactgctctcgtcggttttggcatccttctgttggccacagtttatgtgattgtgatttgcgttacatgggtgttttccttggacgtgccggaagtcctggccgagcaaggcattggggaaggactactgggcctgctagacccgagaggttatcctggcatcggtttgcagttccagcgagtgactttaaatgtcacacgttctcttgcttatttcggagttgtcgaagaaatggtcgaatccgttaagtatctcgacctggcaatctctgaccaacatctccgttcgagaattgatgatctgggtctttctttccgcggatctctcggggtagaggcttggaagagcgtggcaggggactatgccagccgcatgatcgcatcctacaagactttcaactctgttgtggaccgagacgcgttcaacgcggctgtagaggatatgaaggagaaattcactagggacaacttcggcagcaccgcttggtccgcatacgttcgggacaagctcgaaagattagcaaccgttgccgggcaagccacaagtgtagcttttgacaagtgggtcagcacgactgctcaggaaagtctgagagaggatgatggggccctcgaaacgaaaatctcaaacttcgaggctgtctggcctgtgaccaggagattcggttctgattacctacgtgccttggatggcttcaggtcaggcattgctgagacccatgatgagacgatcgtgcaccaggttcttgatcggctcaagcctgtcgcactcaaaaccctcctgcgggagggagtatcgccacttgttcgccaggaaataggcctcatgcaggcatggagagatcgcggcgtgcctgacaaaactagaaacgacgattttaaattccgccttgaggcacgtgtcaaagatgcagtgttgggcatcgaactcgagctactgttgaaagtggcggggaaaggattcagccaaccaatcaggaaagaaattctggaacgggaccctggtctttcagagccagctccccctggtgtcgcttttgaccttgtcatgcagtatctggctatgacagggcaccctaacggcttgggcgtgactccagagaatctcgctgtgatccagaaccttcttctctctgcgacagatgaagacaaaggttttgccgagctactgctgcggacctctcaatcgggtgctgggtctgagaattatgaaaagttgcttcaagcccgtgaggagggttcgatgagctttgacggggactctcgaatcgtgatatcccagcttggtgctctggtggagatggccaaaagagccggctttgaggaaaacaacgcttatgaggcggctctccacaccgcaaaactgtatctggaatcaaaagaattggaagctgacaccagagcacgcgaccgtgctgctattcttgaggagatacaattaaggcatcgccggggtcggcccccgaccgctggtgaaacactggtgcaatggtggatccgcttggaacaatacgcagctggccaaccctttctgatggaaatcttgggggttgtggccacgcttatcacgaacgccaggcagctagtgtttcaatatgccgtcgagcttctggatgctatgctgggcgcactcttgaaactgaaagccaaaagagaactcgatgctttcgacacagtgatgaaatttgctgtcgacgccgccgacatccttggttcccgactccgagttcgaccgaaggtggtatgggcacccttgtatcgcaggcaaggcaaacccttgagcagagccgagcaacttgctctcgaaatacacgggcctgttggagatgcaaaaggttacaaagaagacttagacgcaaccatttcgttgctggaaaagcactatgccggggatgatgatatgccagagcttctgcgatcatacgtacgacccgcattccgcccgcggactgcttttggaaccgcacgagaattcgaaggagttgagaatgctccagacctcctagaccctggtggaatcttggaggcaagagtcgcttcctacgccgcccgaggagtgaaacagggtttggacggtgtttatcttgcaaacgaagattccaatctgcagtcactatcaaggtacgagccttcgggctttgtcagcgaccctggtgtggaggcacttgttttaagatgtgcggaagccctgtacaatcagtaccccgaattattcaaagctccgcgaatgtccaccccggaagctgtcgccgcctacattgagaaaaggtattcaccgggcatacccttcataggacgatattcaactagggctgccatgttcaatgcgggatgggggaaagccattattgaagcctcaaaggaatgtcttagaacgggtttctaccctcaaattcaaaatcacgctttcccaaaaatgcaagtggttgacaaaggcaaactctttgctggaaaaccggttagaacggtcgtcgctcaggatttgctcaccactttcctagatcaagcgttattcctggaacgttcgaagcgacctgcttccgtcgaggcggggattgcttccgggcgcccgctaacggaagcaggcatgagagatttcttcgaggcagttgtctcacaccaacggttcttcaaggccgacgaacgagaatatgactctcgcacaccaccctcgatcatggctggccttgtccggctagccgaacttggttttgatggcacggcaaacgctgaagctaagaaggcatggacagcgactcgttacttgcgtttacagcaatcgtacataacggagctcgaaggaggccagatcctgcggaaaaggcgtgggggaagtacgggccaagcacttaccagttgggacaatacaatgggcgtgaagctcaaagcaatggcagcctgggccatcgcaacaggcagagagcctgagaagttcttcgatttcaacacttttatcaacatgtcagatgacaacatgtggggcacatcagatgattccctcgaccctcgcgacttagtcatgatttacgaacagtttttcggaggagaacttgagattgagtctcacaacaacttggatgagctaatgtttcttgggaaaatgattgaaccaggcgccaaacatgcagcagattacgaagaggtaggagcccctgtgcctagattctctattagggctgatgtctcgaatctcctcatgaggagatctgctttcacaactcgagtggcaggttttagagaagagcaacacatgagggctcggctccaaagaacggtcggccatgctctgctctgtgcccacaaccgaagcctttatcacgaaatggcgaacgagtggatggaagatgccagaatataccttttgaggtctaagggcgaaggtctttttgacataatctgcgaccgcgatggccatatagtggctgcccagttgcgagatgatatcagaccagcctcaagggccgacgcaactcgcctaaactttcttcgcaaagctggccgtttgctcggttacttcgatgtgatacgtgccgagctcaacgaagtggaacttgcgaaactagatgctcggcatgccaagataatgaagctgcagaagccttctgcactcggggaatattcacgcatcatccttgggacggcgagaaatgtgatctcgatagggaccccacaatgggcaatgtccctggcttctgagcccgatgtggaaacggggatagtcccattctacgtgcctgactttcgtgccgaattgtttgtgtacctgagtttggtggccgaggttgacaacgaggatgagatcaccacaagccttttaatgtcacgagctaaagaagctccttacaggtatgtcctcgacatccccggtttcatgtattataagaacaccatcgaaggggcggcgaagctcagcaccgtcaccttcgaagaagcccaaaactacgtggttgccgtgactcttttctatgtcatgttcaattcagtgactgaggctgtagcctcgaaatatgattgggcgaatgcagttcttgaagcttacaatgttgtgactttggacctccccagaatatacagcgtgaccaacacagtcttctggcatatgaaaggaaggtcgtcagttggggtatcgtcgctccaaccccgggacccttacctccatgtaaaacaagcatctcgagtggccgcgtttcttgtacgccatttaatgccctcaagtaatgtcccggcccaatggaaagactggacagctgaactgctggacaaaggcgctcgatttctggccttcgggcctgcaaggaagttgacaatggacgtttcgaagaacatgaccaggttggctgaatggcggtcggtcggagaagtcttccttgagtctctcaaaactgacaaaccttatgagattttaagatcagcaacggggacgggtaaatcgagagagtttattgctgctctataccacagcaccgccgggcaatcttgccaccgcgtttggctggtggtgccacgtaacattctcaagaacaactacaataacccggatatacccgaccaggacatagtgaagatcgaccgtgacactgtggtgcaagggcagcgtctggtcatttcgacgtacggagctcttttgtcccgcctcaacaagctcgattcatcagagtggatcctcgcctgtgacgagtttcatgagggaacgacggaacaagttgctgtggaattcctcacacgctcattcaagcgagttttcatttcagccactccgagaatgaaactgtttcctcacctgcagaaggttttagtctcaccagtagcatctaagtacaaagtggaatacgttccgttacagggtgacgtgttcgcactatttcaggaggcaagacgcctccaccccgaaagagtcgggcgagctctggtgatacaaccttcgatccgagaagcacaagaaactcaactgaaaatgcaagcaacaggttacgagacgcacatcgtttcaaagttccatccgatcgcaccaccaacaggtgtgctaatcgcaacccaagtggtggattcgggcctgacgattagcccgcctccttccattgtcatatgtgacaaggaggcgatcataactgacagaggcataactcagagggccgtcgtttcggcctcgaccttaacccaaagggctgggcgcacgggacgccttggagatggtctatgttatcatcatcctgatgcagggcagggacctgaacaggagccgtaccctccaatgggtctctacctgtcccagaagcctctccacgaacattttaagaggctccaccaaattgtagaaacgatcggccctgtcccgggcgacaattacatgatcacggaaacccacgacccctgtgttatcgcaatcgcgaccattgatcaagaaccagaggaactgcgatcacgagtccttgcatccttaagagcttactacctcatcatttcatatgttgaggatcacgacgttggaaggaagatatacatcgatttcacagtcagaaacctgatgggagaagcagcggctcctgttgaatcacaagtccgtcttctccagacccagtttggtctacttgaatggagcgcgatgataaacaggcttgacgcctcaccatacatcacagtagttggcggccgacgagtgccacattgtgggttaaagctggtcttaaatggagttgtgacgattggcacgcccagccagcagaaaactttcatgcttaacaggaacactagataggttagatgccccgtgaaaagggcgccaattcgttgcatcagcggaggcgaaaaggccacgaattgttgatccatgtgtaacgtgacatgaacaaaactaggccccaacaggctcatgaaaatggggtctttaaagaggagagagcagcgcgctgaaatgcgcactgtttagaaaggttaggagggggcgacggtacaatcggtggcctgaaatggtctgtaacgccctcggattcttctctgttttaattaacaaaaaaaaaaaaaaaaaaaa

SEQ ID NO: 618 - DNA, 10486 bp, Unknown
  derived from dsRNAs of unknown virus
agaaattagaacataaagaatgtcataagatctttctaagtttctgatttctaatccacaggagtaagtatgttacgtgataacgaactgagcagagaggtagcagccaacccaaccaccaaacaccgtgattgcaaggtagttaccatcttgatgcaaccacacaacctagacgtcgccgtaggtttcaaactctcgatcccgagaggaagagacttcgacgtgtactgggtgttggtctatcttgagaaaacgtcctctcaacaaggcgtcttctatcaatccaactctgttcagcttctttcctccgaaactcagtttcggtggcaatttcgaaacgtcttctcaaccttcgaccgccaaagtcttctgactcggtggttcaaaggtgagctcactcctaccctgcctcaccctgatcaggtcgagtatctcacagctatcgcgttggatgcgattcaacgctcttgtgggctacttctcgaggctaggatgcaatcgagtgacgctcttcttcaggtccttgaaaacatggaagacgattggatggaaaacactgtcaatttagacgacatcctagcttccgatcctaactaaggggtaacacatggcgaattcattcgcaggtctcatcattatcaacaaatctccgtctgacaactgtctcttcggcgatggcatcgccgttctcgtcaccttaggtgacgtaaacggcgtttccacagccagaggacagttgtacaagtacgacgcacagtgggagccaaaaactgacgatcttacaggaacgtttgttttgtccaccgctgatgctatcgcgtttcagccttattttgatttccaagagcaatctgctcaaggaacggctgccccagcggccgctctgatcacaaaggttgaagcgtttaactcagcgtaccgtaatagtacggagtacagcgccccttatttagaggggatttacaacaacggttaacccgttaaaggagaattatgttagaatttggttttagtgcaggtgatgtcatcatcgtaggtgccttgtttgtcaagatgcttatcgattcgttgaaagacaagaaattgtcggcagacgagattggtgatatcgttcagatgctcgcggaacagttggccccgaaactcggcgccggcaagaagcgatgacacctgacctgtaccttctggcctgcatccttgtgatgcaggcctatcacattttccttcacaagaaggatctagccccagaaatcacttccgatgactgggagaatatcatccacagtataaacaggagatcagatgagcgatgaagaagataagactgcggcaatcactacgaacactaagtacatggtggttgcgattgcagttggtgcggcagctgtggctgctgtggggtacttggtcacaaaggggatgcttagcgacaccgtcgttaacgtttcgaacccggttaaccccccagctccgacacaagctcgcactcgatcgaagaagaacatgtcccaatgatggtgcgccggttcgccggctaacggcgggtcacgctctatccttaattttggccgcgtatttaatagcgtcggtctttaactcacttctccaaaggagaaacttgaatggatatctctaaaatactactctggatagttggtggtctcgccactatctcactcatcggtaacttgatgaaccgaagccgtgctgacaaagcgtggggacaagagccgctgaaacgacgcaatcctgcgtttggttggcagttctggccctatcctttgctcgaagccaaaacggtttcagcagttggtgaacgttacactcagttccggaatcagtccgacaacgtaaccaccgagccttcaacggtttggaccggccctcgagtagacggctggacaggtggtgatagttgggcgagtcctaccggcactgtttacgatgtaggcgtcagccctgacggcactcccgttgtcatggcagacagctaccgaacagaggtcatcaacggtgtcactgttggtaggtctcggaatcgccgtgctagggcgaccggtgctatcccaggtggctaccttccatgacgatatcaagccaacctattaaggcgggcttgattacggagcaacttcaaacaaacgatagaactgttagatctgctgtgaacgctcagttcaaagcaaaacaagttcaacgtctcgcggactctgtcgaacgaaacgcaaccattcagtactacgctggagtgggtgcaatttctttcgtcgtcctcggaattgtcgttttgccgattgttgttttgcttacacttgtttacaagatcacttctgtggctcgtttcttcaagtgtctgatacctcagctattgtatcaacttgtctacccgtttgatcgggaagagcgaattgctgctttggcacttatcggttgcccacctttgaataagaaaggtcctgctgtgcaagggcaagacttcgatcctcgagaagcactcgaaggatcgtatctgcctggaccatggggtacctcgactgacaccgctaccttcgctaacgcgttggcgtggtacaatgagacaaaagccggcgacgatccaccgtacgtcgaatgattaaaccatccacacaggagtagaatatgaatcccttacccaagggtgttcaggaagccgtaggttttgcgatgtggcgaaagtcacctatcgcgatcaccttggctgcaattgttgttatcggctggctagcccagtcatttttcccaatggtaacggaaatcgaggagaaaaggtctcgacccgttaatgaagatgaattaatcggagatgatgaaaatgaataactcaggtcttaacactactttgcctcgcgcaatgtcaatcacaccaaacgtcagcatcacggaacttgatccggaaatgtttgatgtttcgatctcgtcaatcggtaaccagatggcgatggcgcttggagcctacgggtcccaagctaacatcgctccttctgctgccgtgacgaacggtgctaacggtattacgtttacagctccagcagctgcgaacaactaccctgcccgtgacattgtcatcccagccttccgtctgttgattcagtcgacgagcgctggttcggcaggtaccgtgaacttcactatcgagtacaacacaacaggcgattactacaacgcgcaagctgcagtaggaactcctgtccgtgctacctcgacaacgttcacggttaactgctcagctgatctcaacaacgagatctactgggtaccttctgtctctcgttccaagcgtgagtactactcgccagccgttctgcgtcccgaaacgcaaacagcaggtgttggtgtctctgctggttacgatttgacaatcaagtggacaggaaacgcaaacctcgcggttacggcctatccgatccactccttcaagcagtctgaagtaaaccgcttcttgcgtcttactggcctgcttccatttgtttctggccgataagaggagataatgatgtcaatgagtcttataaatggggtgcgtcctttcgcatccacctcaatccggcgcttgttcgcaagcgcacccggaaatattcagagggccaagtcggcagtagcgggccttgctcgctccgatgctggcaaggcagctggcgtgagtgtggtggttacggccgtctacaacctcgtctcctctaacatcgcgagatcagccgctgagcttgagctacaacagctcagtatcggcgcgttgagcttgctggctcctagtgagcttggcgggtcctgtcccggcgatccttacatcagcaagatgcgtatggagcgaatgcaacaattcgcttccactagcgcagctctgatggacgccgagggttgggctttgtttcaacgtgctgttgcgggcatgtcgtactgtggcgctcgtgcgcgcctagcctcgcctggcgatcagatcgcagatgttgcatttgcaatgactgctgctttggtcgaaaccgacgacttcactaacgcgcaagcacccgctgacacgggtatgggcgtgactgaaactgtcggcggtacccagactctagagtgatcctctcgcctatggtaggcgcgaaagttcaggacggtagacatgtgatgacgaactcatcacttgactactgtgtgggcggctcctgttcaaggggccgttcacaccacggtcttgatcttcacaactttgatttctgggcgatgcccggtggtcgtcagatcagtaactatccttgggcgctggttgctcccttcgatgggtacctaactgagattcgcgctagcgattcttatggtacgctcgtagagataacctcttccaagcagttgctgttagacggcgatcgagactcaggccacttcggcgagaagcggtacgtcatgatgcgctacgcgcatcttggcgtacctgctgttcgtcctgttcctaagatcggaggtcgggtaaacaccgatccctctctttggcacggtggcaaacccggtgatcttctcagtgcacgcacactgttgaacaaggattcgacggttatatacaacgtttggaacgctgactgttactacgctaacggcggtcgcaacctcgaggggttggagctgcttcagatagacaacggtcggtatcccacagtcatgaactcagacgacacgttcttcccgtacaagctggaattaccagagtcagttcctgatgacgttgctaccgaaatcgctttagctgtaggctacacagttgtccccgttggggcgctgtctgcaggtagagttgcagcgaaaaggtttggtttcaaactagctcagcgcgctttgtggacgaacccgttcacactagcggctgccgagctgttatcaccgagcatgatcgctacagatccagatcaaagttactccgcagggttggacgcctacaccatccttggtctcaatttgaacacatacttaaaggcaggcacacccgtcgggtttgctggtcttacaggtaatacaattaattcacgacatccgaagatggtgcattccggcattcatcttcattacgagatgttcatttcacggaacaagagagactggcagcgggtcagtcctcactccattagttatgaggaactattatgacatttattttagctggatttcttgctttcatcggtctcaaggccggtaaagcagcaggcgcacaatggcctgaatatgttggtcgcggtggtgcacagaaagatctcactgttgaagaatcaggaaagaagttgactatgaccaacttgtttgctcttctcatcggtgttgggttgttgtttgtcaacagcctgctcggtctttttgtcattgctgtagcggcgggctggtcctatcaagggcaaagccaaccatacatgacagttttcacttcgctcgttctttctttcgtacttatcggaattgcagcctgtgtcgcctctggtgagccagcctctcccgaaggtcttaagatgacgaaagcgaaatggaaaggtttgagcgcgcgtcagcgagctcgttacaccagtcagtttggctcacccgtaccaggcagtggtcctgacgttggtgccggttccggcactgcgctttaggagttacgatgtctatttacggtttgagaagtgcagacgcagattgcggttgtggtgacggtggagaggaaggcttccttagtggagttttcggatcgccggaacgacgacaagcaaaagcagaggaaaggaaagcagcccgtgaccaacgacgagcgaagcgtacccaaaatcaattggaccgcgcagagcaaatcggatctcagtcgttcgactggggtttcttggccgcaggtggtggcgctcttttcatctcgatcgctctgatcacggctgttgtcgtgctgttcgtgaccttgggtcaggatatcttgcaactaattcaaggtatcactggtactcaggactagcgattgatcgaaccagctcccgactggtataaaactattggcgtgtgtctgcgggaggcacacgccattatcatcccatgtaaaggtaggaaaatgccaattcatttgacaagaatcaactcgccgcttcgtccctatgcggcagacgccatgaccacagttagcaagcaccttgtgtttgacggcattggaatggctttatcgttcgcccgatacccagcgtctcagctgaaggtgtaccacttgccgcacgacgtgttgcgcagtgtgtattcacggaatccaatccgtgacaccgaagagacaaaccggttgatggcttcggcacaggatcgcagaaacgctcctgcagccacagcgttcactaccatcgaggtagatgacagaggaaacacccgagtagagccagcctctactgttgatgtgttcagtactactctacgcggctctgctttggccgcgaaaattacagacatttcctcttttgcatacgctattgcgaaagaggctgacagcgcagatttcacgaacaatctcgctgacggtccaatcgagaacacgcttctctgggactacttaggcatgtgtggtctcagtgatgtcactgtggacggtggcggtcaggacatttctgttcaggtcgctcatcagctgcagagcatcgatcctgatccttttggagatgaggagatcggcggaatcctggactttgcactcgcagacttctgcgctgtgtttcaagtccggttccctgctatcgtcgaagccttgacacgcggtgcgctcactgagcgtctcgctggtctaggttacacgagaacgcgtcgtgcgttgaaccaaatggttgcgatgcaccgtgcttctatcatgtcaactgtcatgcttgctcagctgacgtgtctggacaacgacattacgagcgatcggctggcgcgacgtcttccgacgaaccagttcattaacttgggagcttacaagagcttcttcgagagtgttccgaaacttgagcagcacgtgattcggcctttgatgggtacttacccatctgaggagatttcttacgagcaagttcatcgtgtttaccaccaggtgagccgtcttatgaactttgttccagacgtgatgcaacgtgagttccctcgcctgatgtcaatcgcgatcccgaagatctcgatgcctccccaacctacgatggttgtcactgacaccatcacagtccttccactgaaggatttgtctactgcatccgacacgttggctcagcagttgtactacggttggatcacggatacgtacgaggtcaacaacgcgaagttcgtcgacggtgtgaagccaaccttcacctaccgttacggtttcaacgcgacggagcctaaggtgtcagagttcctgggtcctgttacaggattcagtaggtacgtgcttgcatccgattttggtgagtaccagcccttcaactcggtcaccgcttcgatgagctcggacggtacccgcgtgttgtcggttcctggtttcagtaagaaggactatcgcattacgctgacagttcatcgagctacggagctgtggcaagacctcacgctccaaaccgccaatcaagagatcgtcacaacggtgaacgatctgtactcagagatgcagtacatgattgacgaccgtgaaacagacactcttcctactggtgtctttcttgacgcgcttcttccaagctctggcacgccatggggatgggctgatgtgcctcaggggtccttggatggaaggcctgagatcgtcgagaatgaggtgcgaccaactgactcagttgtgtcgtagtgcgagatgacgcaccggaaggtctgaggagcagcgacgctcctcaggcctccgtccttcggatgcctgttcctcagcaagttaccagacgtgctgttgaacttccacaagttacgaagatcggtcgctacggtcttcttgagccttcagaggatgtcgccgagcctgagacgcttcaaggcgacgaaatcgcgttcggttggcctggtgcttaccaggctatcgagcgagctacaggtaaggtgtacaggtaccagctaggtaagaaagagtcgtccttcgtcacagacgagggtgactttcgacgtgcactagacattgcgagatcagcccgtgacgccggttggcttatctgggaggcggagtatgaacaaatcgagaaatttggagccctatcatccgtcagtccaggatgggcgaacgtcaccgagcctcttacaggtaggacgccagaactgtcttctgccgagttggacttgctttattccaaggtatgcgggtatgtacttgacgaatctaagccagtcgcgacgtctaagtatcgctatcgtaagaacactaaccacggtagtcctacttggaacaattctaacgacgatctgctgttccacatcaggttgggtttgatgttcaggtcacgcaggatgacgttcgatgactgtcgggcgtatcttgctaagctcggagttcctgtagatttaggaactgtcgcgactttgttccgtcgtgctggtcctaatcgtaaacctgtcactacatggaacatgttcactggtactcccgactttacaacgaaagggttgtactgtcgatcacgtcacgtgtacggtttgccaacttggatgaacgtgctgatgagacctcttgcctctgaggcgaagtctcttatgtacggccttcctcggcacttccaccaacgtcctgagacaatcgcagcgatgagaggttcttcctatatgttgtcagacgacatatctggttttgacctttctgtttcttttgagcatcagaaacgattggcgaagtacatgtacgttcctatgatgaagcgtgttgatccgaacgcaggatattggaaggacatctacgagcagcttcaaactggagtttacattatagctcctccttctcaaggcatgagattgtcggtccaaacggatcgtacagcgttctacccttccacgacggggcgtattgttccccgtcatggtatcacagcttctggctctgtcctgaccattactgatggctctttcatcaaccttactcgtatggtttatgcaatgtgtaggtcggtgccgaagtggcgagacatgtctctatcccacgctatcgatagcgtactggactcgtttaagtcccgggatgtagaggcgtatttgcaaggcgacgacgttctaatggctggcgaagtctttagatcgttatctgaagagagatgggttgaggcatccgaacaattcggatttggaactaccatctctagcgaccctatctttctaatgcaagccatagataggaagaggcgttattcataccgattgacgtctaggtttctgcaaaatatgttcttcagagaacggcctaagtcgggagagttcattgaacgtctctcgttcgcgaccaacctgtcccaggttgtgttgcatccgcacggtcgtactatgttaaactatttagaccctctgatcaaagagcggtttgccggactcggctgggtccagctaatcgatgcactgcaaagcggcatccttgctcagcaagctcagaaggaaggcggcgccgcatcgtttatgaactggctactgtcagtgactcacggagagatagacgatgcgacgcggcctgagattttgtcgcttcttggagggagagcgaccacgttcaacgatgtcaaatccttcctcaccgccaacacagtcgaggtggcccattctcaagagcgagagctcgcgaggacggacgtcgcatattttcagcgacatatcgaccaaatgtgggagcagcctgttcccaacaatccacaggagaaagaagatgaaactggacttttctaagatgccagcacaagtagatagcgccgggttacaactacctggtttggacgagattgcaggtctgagcacattcgaggtttctgccgacgatgactcatcacctgtaaatcttcttattctgggaggtcacacggtggacggaggtgcgtactctatttccacgacgagcccagagttgattaattactacactagcagggtaagaacctatgctaacactggcggtccgatcccattggcacaacagctgctgatgaactcggatttgcaggcgtctgtcatggtagatgagcttcgagctgaagcgcatcgcgaggcagagccggacgttgatcaggacgtcactcctgaacagtcagagtctactgtggatggcggttacgaagacgaccgttctgacgagtctttagacacaccggtcgatatggacttggagcacaaagatgagcacatcgaaaaggatgagcacattgatgagcacaaggaagaagacggtgaagtcgaggacaaagacattcacgttcttgaagatgatcacatcgacgaggacgagaagaagaagaaagaagaaatgcttgattcttagctttgtcctgggggccctttatagggcccccttttacaatcccaaaaaggggatccc

SEQ ID NO: 619 - DNA, 9164 bp, Unknown
  derived from dsRNAs of unknown virus
agaaaaggaacccgcgggttccctctacagtttccttttccggaaccaggccgtccctggatatttaataactaaatcgtaaaatatgatactaattcatgtaaagaaccgttcttcgaacttcttcactcctgagtactggaaaagtctcgtcggtgttgaaaaagaagcggttactaaagaaaccacgaccagttatcttgttgataacttaaacggtaacttaactttacaacgttgttcattcgaaggtgtagcgctggctggcgttaagaaaacggtggtaacggcatatgctgttagtgctgtaatcgatacagagtcaccagtaatacaagcagaaaaggacaaagttttcagttatacaccggattcttggattaagactagcgttgtgggtttacccaaacgtatgcctatttcaaagagttatgctcaagatggtaaggtttacttctatttcgatagtgtcaaagcgaccgtgaactggtctgttaagtcattcaaaagtggcagtacagataccaacgtacccggtttctaccgttcttggagcgcagcgacactaggtaatatgattagaggcttggctaacgacaagtacttctctttgattagtggtgccctttcggggtcttatacgaagacagttaacataaacgaaagtggtgtcattggcacgattaaagttaagttctctgtttgcggtacatgtgattaacgattttaaattcttaattatggataattggatgttaatactcggagctgcaattgtattgatagtcattttcgttgtacttattggtggatcgaaaaagacggaaatcagacaagagaagcgtaccgagagagtgtcagtcagacaggctaaccagaccgctcgaacggactccagacaaggaggacgtactgatcggaaagttgctaagcagagtggcaaaacagatcgaaccacggctagacagaatagacgtgaaaacagacaagaccagaagactgcccgaaagttaaacaaaaggcaaattcgtcattgtagaaaagtaacaagaaagcaagcaaaagggaagagagtaactgttcctagttattgcgcgtaagtagagttcattaagtgaagggccggctcagccggtccttcttttattaacaaggtaaaatttaaacatgaaaagtgcatttaataaagaacccgcaactgatagcggattaccaaagggattgaggcctaattccttttatcagaacctcatcactctagctagtgttgacagtaatgtaggaacaggtaagcctccgacctggtccaaattaggaacaagcggttacgacaagtaccgtccaaacttatttaagtacgaagatccttataaattagacttcattggttacgaaacaaggcgacagccagtcaataagttagttaagttttcgtctgttacgagcgattctggtaaagaaacgataaccagctcacctcgtgatttcacgaagtctcagtactacggcggtttcatgccttcatcgtcattcttaatcaaatggttgagaggacagtggggaatggaagtgtcaagaaagactttatcgagttggggtaacaaacgtaagactagatttacgatacccgcagctacgattaaggctcacaacgctaaacctggtgctaagcagatgacatctggtgggagttacacccacgataagttgcgtctacactacgggttagacgtccagaccactccacggtggacatctaagttgatagtacccgaggacatgctgatcatttacaatggtactgtttccggttacggaaacagactagaaatggttggaatatacagcggtcgtattatcacttacagtcacatggcaacaagcaagataacacaaggactcatgaaaggttctatcatatcggctggctctacggtcggtattagttcaggtactagcgcaaattctacaggtggtaaagcttacgaacattacggtcctcacttacacttagagtgtggttgggccggttcagttcagctaccgggtaggaatgttacaccaaagataatcgatggtaggtttaatccgaaatggaaacaagccgttaagaagcacattctttcagcttctctcgagtctagtgtattcacttttctcgcttgcgatctaatcgctcgtgaaaaaggtacgactcagacgtctataactatcaaagatggtaaatacgtttcatcaaccttgggagccagattaccttcggctgctaagttgtttgaagtgggtatcctccgaaacccatggtattactttaccttcacacctgatcaactggaaggatgatgagtctcgatacagcttatcaatatcctttgtatgttagtctcaatttagacggggccctttacatagctcgagctcacaagttcgagaaaactgggcttcatactaattacaacgagctctggtcttgggactggttcatcgatggtaactttgattctaacgtaggaggtattcacgatcagacatgctcggaggaagcatggcgattcttttacagaaaggcagaccctggtttcttaacggatttactccacgagacatcaaggtatgatatcaagttaacgagtgtagcttacataggcggtgctctagctttgcttgaatcgaggagttttatatactccgacgccactaaagtattctatctgaaaaacgatggtagttggaaaactcttaccccgactgaatttgtttatagatggagaaagcaatatgagaagtacaaaactaacactcctagattaactcagtgggaacgagctatggttcaagaagactggcgggattgtgacacttgtacctctcaaatctatggatataaagcgtaagagcaaattcttaaataaattaatatgtacgtaaaactatcaccacgggacgaaaagtcagtcggagcatacgtcactccgattataatctaccctggtaattcagacggcgcggtaaacatggacgaaggtcgattggccctcattgttatacctatggttaacgactcacccaacacattaaccgaatgggtgttagccagagtggaagaattcgccacaatcccagacataaaagaaattctcgattcagaggaaattgctgaaatggagggattagatgtgtattcttatgttcaggctactgataagtatgagaaacgaagttacgacgaagttttctcttttgttgaatttaacttaaattaatattatgagcaataaaacgaacagaggtgtatacatgtcgcaattttcaccttcagcagcgaaagctgataacggggagttcctccctttaaacccatttggggatgcagtcagtgcagcgaacacagatttcttagtgcctatgcaggtagacacagttgaatttgatctcgtcgctgatatactgggtgctccatttgaaaaaggaaccgacgcacttgagggatcagatgtattcaagaaagcaattctaaactggaacgagagcttattatattcaacaccatccgatggttcacctattgaaagcgatgtttccggtacattcggaactgttgctacgactagatggaatactgtctgtaacagggtggcatccatttggcaccaagatatccatcggctgactaaagagagagcgctactagcgttcgatcgtctgaaagacacaacaacggcaacagacgtcagtacattagtgagccctgctgatactttttggtcggtatttcctactctatatctatctgagcttcgtgctaacagaggagagagaggtagaatatgcgacattaagttgatggctcaagcagcgttatctaacgctgctattgaagaggtggagggtatgtcctttattggatctgcccgcccctctttttataatgttacgaacaggaaagatggtatctatcctgagtcggagaaatttggaatgaaaataggtatgttcggtatgcattaccacgactggatgaacttcggaaagcggagtttgtggtcaaggttaatcaacctaaacatgggtgctgtgagcggacgtccgtatcctcaggttaagcctggaaacgcagcagatcaaaaagaaatcaacagtggcaattcgggtcacctttattggaacaattcaaacaaggaattgatcgagatagataaagaagattgggagaaaatgttcttccagcttccttttcaaccttggtggattcaggctttgatgtttgaaagcgtggctcgattgaaagctgttggtaaaggagtcttccaaactggaagctctctgcgttcaaacaggggttcagttggtgcatcagttgcatcatcttacgctccgatgttgttcgtggacaagagcgatttgatatttggtaacaatattacttcactctctaaacaaacctttttcgtaagggcagaggcgaatttcgccagacttaatttaccattgactatacaatctattcttagggagggaaccaagaagcagggcgtaccaatgtcaattctttttccgagtagatcgcgaaaagatataggtatgagtcacagtgccagtgtcgaaattggacctgcggaggtatcaatgttggtatcacctacggactattccgatgaagagacctcacaaatgagttggactaaccgagctgtgtttaaaacgcagtggagtacagatctgattgatatgatgattcggaatggagtgaccacttttggttgcagttttaatctcttcgaaccgagtcaggatagtgcatatttcctacccgtgacgtcagagaggagttaccgcgcttacggtacgacagcatttatttatgcgttgaacgtaggtatttatgacggagctgaacgtagccctggagctgatgataagaccaccaattcaattgtaagtttggtttcgatgtccagtgctaaatcaacagattccgtccagtttaagaaagtcgcacaaactcagactatctcgttgactagtggattcgactcagtcggattctttacgccagcgtatgaaaagtctaagtgacaaagtgtcagtgcgttattgtttaataatttaaaacatacattatggaaaatattggaatgttattaatgggtgctttcacacttatcgttatgatcgtaagtttcatgactttagggacgattaacaccctcgtagtagccggatcaggtgcagcagcgtatcatctctactgtcactacttcggtaaaccatctgtaggcggttatgacgctatggttggttaagatcaaaacgctattgagtaagttgccttggttggttaaattagttaagggagttgcaaaactcgtagctttactaacacctcaaggcatgcaccttgtatataaaaaggtggtgaacggtaagtgtgatgtgacagttaagaaagtcgatatcacggagaatgatgataaccaaggtttcactgctcatatagagatcaacgttacgagtgagaataaagaggcgctcacttcgataaagacagaaatagaaaataggcctctcgaaaatttgtaaataaaatacataaaacataattattatggcaaaaaaagaaacaggtgcgcctagcgttctctcatcttttgcggatttagcaaatatccctagtttgattaataacacaaactcaccggttgacgatgctcaggcggatgaggatttcaacgaggattatttggatgcgcaagatttgattgcagaaccaggtagtatcgtcggtgtggctggaaagccaatgaccgaaatctctattgatggaagagaagtgatccatcaaccaatgacaatcgaaagcatgttatcaactcacgcaccatacaggttcaaagttgacccaacgagaatttcgtttaacggagcaggtcaattaccagctcttggaaacgcgacttcttttgttttcagaccaacgggtatcaaagatattccgggtcctggaggctggggtgcatacccgtggggtacaggatggccgctaggtattgttctacgtgtagttatcaacgacacccaaataggtgaaggttccattggaatcgaaactttaccaggtttgaaggctgaatggtctgttaccaatggcgcgggtgagtcgatgctatgcatactttctcatcaagaggactacgtaattaccagtcgtactgaagttgcgaatcccgctaatgaggaagttgttaagaagttggctgaagggccgagagaagagttgttcttcactccgaactctccagtaaacttaaatgctgctactgctgctacaggactcgaagagtctcaggtaggtggtgctgcggataattacttctttacacctaataacgaattggattatattatcacaggagcgaatgtgattgtacacatatacccgatttatttgacaagagagattcaagctatcactgcagctgcattaacagctgatagattgcctgatcttgctggtttcttcgcagagggttatttatctcaagaataaataacactcgttgtttccgagaacccctcctctggaggggttctttattattaactcttaattcatataaaaatgaaaagattatttatgtttatcgccaaaaacggaatgaggatattccgaggcgctggaagacaggtagcaaagtcgtgggcattcgtcagtactcgagcaggattaggtagaattttcaagttagcattcaatggttggatgatctatgatataggtcaattcgcttacgaatcgatttggggtgactccgaagcagagaaaagggacgcacacgattggattttagaccaattcctatcaccagaaatttccgcagctctaggttatgagctatcggatagtgccgcagtgtcacatgcttacgctgcaaaatcgatacgtttcttagaaaatactatcgatgctgaaggtataaaaggacttgcttacgcagctctttcagtttacttgagggagtaccctttcggtaggttggctttcagtccaacagaaatagaaacagtcatagttaacgaaacacaagcattcttaattgatgaagtgaatccacctctaactgcggaacaatcggcgaatattaaagctgaaatggttctagcatttgaggaacttgacattcaacaagccgagtacgctcaaatcagaccgttcgatttcatagcttatgtgatcaacgatcttgctgagtctcaggatgtagatacttctgggaatccacttgcgattccgtttcagccgttagatgcaaccgacgatttcggagcttaattattaacctttaaaatttagaaaaatgtcaaaattagcaattttcaagatcttcaaaccatcggtttggagaagcgtcaaaccattaaaaagaggtttgtggcaaagaataaaaagaggtggagctgcagcttggggtaggattcgtaactttacagcgaataaccccattctaacaggtaccctcgccggtggtgcggccgttgcttttgttaataagttaacaagaaatgtggccgatgtaaacatggagctgaatcaaaagatgaaagcccaaggtttcgaatctacccaaatgaatgagtatagagccggaaagatgaaacacgcttttcaaagaatggaagctctaattccctacttacacaacaactcgcaagaaggtaagtggttagaatttatcttttgttatcacgaggtactcaaccaatttaccaatgaagatttagcagattttgctcaaagtgcgaataacacagtgagcggattaagatcttgcggtcttactttggaagataagcctagtgactctcatgtagtatcagccttcagaaagctgaaagacggagagcctactgtggctgaagacgtgcaagacttgatgtcagtcatctacgtagattcggagatgcaactgccgttagaggcttgcccataatgggttatttagatatgatccaaagtgaaggcaaatcagcagcacgaccgggaactagacgcacgcctagttcccaagctgctccgcctccacgaccagaggtttctgaccctctaccgaaggaatccgttacggtttccgaagaagtacatgacctgatattcgccgatggggcttatacagaccattccgaacttgatcaattctggggcaagtacaagaaattagccggtacgcctaaacagggtagcgttttatatcttttcaaacaacctaaggttggaaagaaggaaatgactctatttatgactgatgtgtatctcaaaaggttgatgccttgtattcttgatcccgaagtagatctggaaacgtactttctttacagtttagtagttccgcacgctcaagccgttgatttcggtgagatggtacacgaacaagcccaaaagttgggtgtctcacgctggaatataatctcccaaatgactgggcagagcatgacagaccgtggtgatagtataaaccttatgcgtcaggttctcaggagatatcctaaaatcatggatttcttggttccaaaacgtgtgaaatacgctgaaaaatgacaactagaaaattaaaatatctatttatccatacaacagctaccagacctaatagagcagccgattttacggctgagacgttggtgaaaatgcattgttcaccaccccctattggacgaggttggaaacaagttggctacgcgaaattaatattaacttctggcaaagtagccaccttcgttaccaatgatggtgatggactggtggacgctaaagaagtaacgaacggagtaagaggattcaactccgtctcgagacatatttgttatgtgggtggtctcgatcagcaggggcgtgctaaaaatacgctcaacaaagctcagcaagtacaactaatgtccgaaattgaggacgtattggctgagaatccagatgtgttcatacttggacataatcaggtgagtaacaagggttgtccttgtttctctatccctagtttcttaattgattgctattcaaagcagacgattaagggacttaaaatatctaatatctatctacgcgatgactacggttacgcgcagaaatggatgtaggtactgggccgacgggagtcggtcctttttatccc

SEQ ID NO: 620 - DNA, 6852 bp, Unknown
  derived from dsRNAs of unknown virus
gagaaaagttagtggggaggcaacgaggattttcccactattaaccctttctcaacggaaacaatgaagaatacaatgaaatatttcttaagcaaaatgagtggtaaaccacacggatgggacgtttgccctgaaggtaactatgtcttcgacgcgaccaccggtgaattcgagatttacaactcttggatgtccacactgcacgcgatcaagagatatcgctacgagattaactctgtcacagtttatgatggcgggggtcacgtagggcacactcttagtatctgtaaaatactcaacgatttacaggtaccgctcgtcatatcggaggcgacatccagcggcgtactatacgcgtgcctccaaacttacgaggtaggcactcactactatcctcagtacgtcggtcctaacggcatcgacgagatgggagatacgtatgcacatctctacttccatggagttagcagtgatggggaggacgatcaagccgttcttaccaatcagttagcatccatggtgttgaagagtagtttgttcgatcccgatttagcgaagcaatacgctaaagcgatgatcgaggttgtatgtcaagcgatggacaggaaaatcaaacctcaccacagctgggtagtcaaaaagattatccgtaccatgggtggtgcgtggggtaatagtacaccttttatcttggacgaagatgtttctgagtctttattatcaattaaaaatgttaagtcatgagagatagtatagacgcagttatcattggttcaatgggagtaggagcatcgcattttggtagacagatgggagccattgaactcgatcaaattgctggtgtttcagacaaactggactgggtgatcgaccgttccgagcttccagagcacggtgcctatgtagttggaccaacggagttcgagcctcaagaatggataaccaaattaaatcctgatgtgatctggtttgttactacaacaccggatgtctatcggaagatttgcgagctgaaagcgagggacctggattatgaggagagtcctgatttgagggatcactatctacgcgcctcaagaataacaaacgaggcgtttttctacttccagatcagtgtgagagaggatgttctcgatatcgctcgagaaacagatgctctcgtgcttaggtttgtaaattgcgctaagccagaagaaatcgaagctagttggaaagcggagaaaattacggaggatgtcaccgccgatgagaagagtgacactattaattaatcttcaaaatcagaaacaatgaatgaagaagaaaaagaagcggtagtccaagaagaactcgaggacatatcggcacctgaagagaacaaaggtgttaaaactattgttatcacggtacgtccagacgggatgtccgaagttgagtatcaattagatggccaaccactaaccaaagatgagtacgatgtcttacctgctagactcgcaaatctctttgagctagctgagctatctttaaacaacgagtaagttgttagccaaatttaaaagatcagcatctttcgctagcgcgttggaaggctggatcggtgaaaagtacagcagggtacaatcagccgacggacctataattaggttgttttggttatcaacatcacgcgagttcgatggtgcatcggtcgagcttgtgtgtgactgggatacactccggttgttcatggtggcaatgaaagagcttcacatctcacaagaggaagcaaaacagggttacccgaacatcgaagtctacgacgtagaagcctatcttgacggagaggattttcacgttccggtggactcagtgttaaacaattcctacattgcttgaagcgtgggattgggtagtgatgaacgttacgagagaagtcatcgctattagttttgggttcttgttcatgatgatgttcggtattgagatgcacaatcttgccgaaaagtatcgttattgggcacgaacccttaagccacctcactggttgacgagagagaaaatgaatttattcatgttcttgatccttatccaaatgttcttggctatttctctcacttttattttattaacatttttatataaaacatgaaacaattattaagcaaagagggtgaagaagcgtttcttagcttggaaaaacagatttcccaagcttttaagaaaggtgactccccgactctttatctgtacgacactgatggagagagtgaaacgcaaatagcgtctatcacattacaaagaaagagtaatcgcggtttccgtttatacgacgtagacggtaagcggtttagagtattctcttggttgaagaaggtcaacaaacagtttccacttgtggatgaggttgtgttggatctgggagctcttgacgttactttcgatttggacgataaatttatagggctcaaatttaacgtagcagagtttgttaccaaatggaacaagcgaagagttgcgaaagggaagagaccttttaagatacctggaggttcggaggttaaactggacatatttactaaacgcaataaattttaaattatgcaaaacacacaaattcatcaaattggtgatactttaaggaccaagactgggaatatgcttcattccctctactttggtcaattatttaatcgaaaagtgagtgtacctgtcagggtatcgacgactcaatttcttctcgatttcaggactacgctccaagagatctatgaagataaggaatctatgagtcaaggattagtggatactattcttggtttactcataaaaaccaatcagactttgggcactgatgagataatcaagaagctcgaagcggctgatgtcatccctcaatctataattggtgagaacggtgagatcaaggaagacggcagggagaggttaagcaaaatggttactcagttggagtccaagattgctactcacactgttcaatcgggtctatccaacataatcgtgtccgatgtattaagttacaaggataatcagacttttgatctttcttcgttgcagaacgtaggaatggaagaagttagtaatgttgtgcactgggctcaggtgttctggaatcagttcatatcgcaagccggtggtgacgtattagctacggatttagctgctaaggctagaggtagtgagttacttaagggttgtagaaacatgtactatcttttcagatcaggtactggtgctcatgtggaagctagagaaagttatgtttttgacaagattttcgaggctatccatggtgaggacgagaaattggtagagtgggatccgatcatgaagaacaaaatctacgaagttggtaaaagtcagatgccagacattggtttcgctgacactatctcggctttcatgtggagttgttcgactatcatgggtcttagccctactttagagaacggttctgagtctctagcaggaatggtagatcaacaggttttgggtatagattctcaaaagttctacgttccgacggaggccggtatcatggatcccgagcgagtgaagaagcactataagttgacttacttgttacatttgatcaaacgctttatcgctgatgatccgggtcaatttatggctaccgtaaataatagtatcgctggaaacagattctttgatgctaaaggtatggagcagatattcaacgaagagttgtactgtttgtctatagctttcgaggcgtttaaagatactgcttatttctaccgtaaactgtataagtcggatgccgttcttttcgaagattgggcagatgttccgcctcaacataaatccttagtgattaaacatgttgaagatgggatgttcgataacgctaagcagttcatgaaagctagcgatcacccagcttactggactcagaaggctcacttgtttactcaagagggtacagatttgaatgttggaccgttgtttgctgagccttttatcagtcaaactgcgtgggcggacatgccgtgggagagagtggtttcaagcgataagtcatcatcgatgctaagaaggatagccggtagaccggttcttaatggttcttggtgggacatgagcgatgctaaattaccgttcgacagggacactatagctcatagatctttagtcagtcctaaatttactttccagataagagccgctgagagtataatgtctaacgacatcgtcaaggcgaagtacacttgttatccaaaagatcaaatgatcagagagctgtctcgaatggaagacaccgggttcactttgatgatcaaaaagatgggtgaggaaagatacttcacttctgctgcagagctttcaaacgctctgagaattcctgttaacatagcctcagctatttgggactccacacctttagcgggttgggcgactgaagagcaaccgggtaaagagttctgggatctatcagctctcgaaggaatcatgttcgttatgaaaccttcagctgcgaaatactacgagtattcggagttggaatcctcaactaatgcattcaatttactcccattcgtggctgagtatccgtgtgttatagagcaacatgacaacatgttcagaactatcgaccctctaccattaactgaggacggtataacctttacacctgtcggttcaccaggtaataatcacaaaccagaaacgttcacagatgctcagattcaacaatctacagtagctaaagcgaagacggcgggtgctaaaccaggcttaactgatacaaaaggtaaagttaaaactccaccaactgctaatccaataacgggtgagcaatctgatgacggttccgagtcaatagatagtggtagtaaacctaagaaaggttaatgacgactaaagaaaagatagtcgctgagtatccaacgcagtacttcaatgtccgagttttcaagggcggcgaggtactgccggattctttaccagctgttacaacacaggcgtcgcccattagggatcacggcgcctttgtttctaaaagggtgaaagattcaaatcggaaatacgatcggactcttttagatttaacaaacgcagctaaagacatggccgacagagtcaatctgtatatgcctgttgtcgagcctttactgacagattacgatatcgaggagattattccttctacatgcgctttgggtatgtggaattcagcttctacggatttcgagtctttaggtcaattaggtttagacacagatgttacttatccaactgacatcgttagagacgtcatcacctggtacaaaaattatctcaaacctccgggtgaaaagacaaacactatggtgcggggtaagacgattggttggccctatatgatcggtggtatgaacagagcggtgaatgatatattcatggctatgtctgcggctgtcgtaaatggtcacgctattgctaaccctttcactaatagtctccagagtcttgttcaaaatctaggtcgttatcatggcgatccgttctctatggaagggaataggtttcaaaacagtgctaaaccgcgttacgctatagttaaggaaggcgtttacaagacatacaatctaaatccgcgttctcgtattatcgctgttgaccctaaggtttttagtatgataatcaggactgagactaagactatgttatcgtgtatattaaacgcccctcagcacagccaagaccgtagcgatataaaacggagaatcgagagcgctaccaaaaagggttggaagatctgggcagcggatcaaagtaagtttgattttagacacggcggtgacagaggaaggcagcaaatagatatccacgctcaaattctgcaatctaaattctaccaagaggcagcaacatatgcgttcaacacgcggttgtttactttcggttacaaaaagatgtggcaggtaccgggtgattctttgctcaaatctggtatgggtacaactactcttatcggatgcacggggagttggacggctttaattgctgcaatgtccaaatctcttaacaaaccgggttatcaaatcctgaatgagtacggacgtacttgggatgctttgagctggggtgatgaccttgttctgatgcacgaggatccttcttggaaggagaaaattatagacggttggaattactatcgtctagatgtaactgaggaacctacagttaagtatcttggaaacaactatgcgaaaggtgattttaaaggaactatggacaagggttactccatggggagagcctttcagcagcagttctttcctgaacggaagaaggagtatcctttttctacaataggttacatcgcgagattagatctaatgggccctaaggctcaggattttcatgatcgcatgctccctcactttgctgagcttagtctaggtaagccttttaggtttgaccaaagacacttacggttggagcaactcataccggagatgcagaagtactcgaataaaatcgggcaaattgatgacgttcttcaagtgttcacccatggattacagggtctggatatagagaacgaaatcgatattcctgatcagtacttcgaacttttaggtatgagccaaagcgtggatatcgatgatccgctgtcctggttagacacgcagaaaatcgataaccccaaggtgtttgagaacgtaacaccatcactgatgcgatacatggccgacgtcgcttcaggtaattttaacaattacaacaggatgctatacgaaatggtatacgcattcaggcttacgtacaatcgagggagtgttatatactaactcaccaaaaggcccccggaagggggccttttatttttggaagttttaagaaacttctatttgtgaaaacatactc

SEQ ID NO: 621 - DNA, 5423 bp, Unknown
  derived from dsRNAs of unknown virus
acactaaggaaaggtgaaaaatagatgaaaatattgcccgtagtaaagaagcccgtatatccgaacacaacgctgaactcattgctttctgcaaagagattagccgtccagcgtgatggcgaccagctcagacttgatttcaggtctgcagctgacgtcgccaaccctaacctggacgcagcaccccgtgggagttttaaccccgcttacaccgaggttgcatcgctgttcgagctagacccgactgctgttctcagcactgctcggtctgctgtagaaattagaaaccccgttgcccgcgtaggcacaaccagtgcacatcgagagatgatgtacaagaccgcatggtctgcaatggttggccagtggtggcgggacttcaacattctctaccgcatggccaaggatgctgaaactcgtcgagactcagttacaactgacaagagattacatcctaatctcgacgttgaagatacagacggcttcgtggaaatgtttttaagtgctgttggtgatatcgacgattcgttgatgcgatatcccattgacaaggccatcagtgttgatgctgtatacgctcaagtcgtatcccgcatgatacctcttgtggaaaccctagatcattatggtttccagaaagggttcgacacttacgcgaacgtcgcgggtgaagggtctctaccgggtgcggtaggagaaagactcttcacattaccagcgcgtacgttcgacggtcttggaagagctccctggcgtgcgttactccgtaacccacgcgccagagagttggctcgatctgctatagtcagtagattcgaagcagcacttgcggcagccgacactgcgcaatattcagctcttgacgactccttggacatggaaaattctagattctgtgttctaggagagggtgacgacatgctcgttctccctattcgtaccactctgcctgccaaccaaggatccgctgacgtgagacttctacacactggcccatattacacctcaggtaatgagatgtttgacgccattgtagctgagatcgacggcttggatcccctcaccacggcgagttaccaggaaaccagcgctcaagctggtctttctgaaacttactccctgggtggcggttggtggtggcatcatcaattctataacatgggtgatcttgttatgggactgtttgatggcactattgattctgccgtgccaagtttgctctgcgtccgaattcgtgacgttgacactggcaatgacggtataaacaatactgctgtggtagaagctgatgtagtagatactggtccgctctggaccgttaactacttcgatgtagaatgcgtgaacatagtttcaggctctacaaacgttgtagctaacgtcgaatggactgctccaatcgacggagtgaccgatatctctctgccaaacggcatcttaaacataggcagccccgctgacattacagcggtgcagctgatacgcttgcttaatcttcttcgtgacatgtggtcccctgatcatgaatctttgatggtcatgaccaaccgcagaagaaaggtactcccaaaggcaagttccgtatcgttgaaaggtgcgtccacagcgttgggcgatatgattctacaatcccaagttcgtggtaccagactacctctttctccgtcttttaacagatcgagacttgagctacctggtaaccatgggtgctttacctaccctatcacgcagcgtgtagaaccgaccgtgtacccctcttctagagactggggtgcacgtgacgcgactaccgcagtggacctttcgctacaaggagtgccgtacggcatcgaagtagcaccttcacgtattaccggtcaaatgtcgactggtaaggcgggaggttggttacccggaggaataccaggtaccagaaacgcccaaacggtgactacagatttgatggccatgcctctactcgagaatgcgtcaactcagatgtacaacaatggtcttctatttggtgagtcaacccgcgttatcggaatcggtaaccctgcaggtcaagataatgagtggattcactccgctctacctaacatgcagaatccagggatgtacactcacaacgtagaaaacatgcaccacgtgatggactaccttccagggtatttctctattggcggagaaggaaactcactcggcccgctgaaccccactcctcggatgtgggatttatcacgtagagatctctctggaaaccagattattgatggagtgcaacacactgccttcgtcaacggtctgattaggttaaagtcccttagcgagagtgatcacactataatcgatgctacatcgggtgtcaacgcctatgtttatggcgatgacttctcagaattccctcaccatgagggctggttctgggacccaggttatacgcaagtagtcggtaactcctgtcaccgactgtgtggtcttacgttgggtggcgcctcttggcttcaccccttcgttctcggcccaattagtgtatttgcgtcctacgtgcctctgtcagacttgtcagggaccgtggactgggaagacagacaaggcagagtcttagctctaacagctaactccactatagatgcctccatacctgagcgtgtcgcgctcaccacccggatgaccggcttggggattactcaaatgggtagtctcttgcctactcctggttttggtattggtggcagtaatctagagactggatatggccatgccgcgtgtgtcgtcccaatgaattcaccggaaatcatgctaagtaagatggataacgaaactgcagttatgcaaaacgaggcggtcgttgatggctacgctggaaacgtccctggtaatcgaattactcacttgagtatatttgatgcgccatgggctttctatcaccagccaataatgcaccacattcactcgttgcctaacagtaattgcagaaaccctcttcttaagttcggtggatatgcaataatgaaatcggaaggttcagagaaagcgatggttcaaacacccgttcattcatttggatggaacactgtcttgccaaacagtactgagtactccctgtggcaaggtgagaatctgatgcctggttgcaccgcaatcacgcacgctcaagctcaagaccgatacgatacacaaagtcttattgcatgcgtcataacccatgacatgaatgggctatgtggcgagttcgaagactactcctacatgactagtcctactgcttggtacgttaacaagcaggctgggattgagtcacaaccgggtggttccattcttggaggccagaacactgggtatttcgctattaaccaatataatggtaaagtgattgccgcggccactgaggtaggattggatgtaggtgtccctctgttggaggcagactatattggtctgtctgcgtttggtattggtttaccagcacctaacagagacacatctccgtaccccaattcgttaagcggtgatcattggttcagtaaacgccttgatcaaaccgggaacttcaatgttgaactagtatatcgtgcgcttatgtctaagcgtaagaagatttatgagaacccttggtctgataaagatgctagtcaggatagactcttcgaatcaatctatgatagctcagagatatcgtcaatcgtcgaagctattcgcagggctcacgccagcgaaggtgccaagatgactgaagggcttgtctctgaagcgttcctacgacttcagatcgttaactgaggtgtttcagtttggtcgatatagaagctttcgatgtgagagcctcttatgaacaactgaagaaagacgtctccgactttttagatataaattctgaagcagcttctgaaaagcatgaagaagttgcggataatttagctgaaggattcgcccgtgtaccgggtgacttaaagcagatcgcgcatactagctacgccgcctatgactggttcacagacttggtgtcggaagctgctgcgggtgtgaccaatgcagtggcaatttatggcgcgtcaacgtgccagcaattgcttgctagtattcacgatcttgctcctgatctaattaaagacggatgggaacccactatggattcaattgctttacatctccggagcttacaaggttcagcggatggcctaaacgactctctagaaactgtagcctctgtgtttcagtttctgggagacgtcaatggtcccgaggagccgaactgggatcaggtcaacgaagacgttgcttatcttatcgtaggcgtcaaggaagaggtatctaccgatatcgcttcccttggcatcataatggtagattttcaactcgggcttgactacgatgctagatctaacccggagtcgaatccagtgtggttttacgaaaagcaaatctctgaagccgctatcgcggaggacctcgagcgggtccaagaactaatgaatgagttcataatttggtcgtacgagaacctccctgaggatgaacgtatgaccaaatcggacgcagatcagttctgggctgctattggtccttcctatggtggcgtcggtggagattttgcaggtcaggatgagggcccaatgggacaatcgttcctaaagctactcggtgcatcagcaggtgctggatccggtacgtccggaaaaggcggctggcttgataaagccgggaaaagcgctagtcgaggcatcggctggggtggtgctttagattactttgtctctgttggttctcaacaggccgcaatcactgctacgagagaaacgggtgaccgtgaactcgatcaagatgcagatgatttcggcttccctggctggccctctgacgaagaactcggtttgaaggataaggaacaagacgcagaccccgacccggtggacccggatcctgtcgaccccccggtcgtacctgatccaccaaaaccaccggttatacctacaccagtaataccacctatagaaataccgccctgggcaataggcatcccaggcctcgacttatcgttgggtacgataacgttagcaggtatggcggctatggtgggtacctacggtttctaccgtgcggtaaatctgttggcagtaaacgggatagccctaccacctgattggtacaccctggaccccgatcagatagatggaattcactacgattccacggacttggacgcggcgcctcgcgaagagtcacccacaggcatcagagttgcacctcttgacagaatagttgagggcgacctagtcgaccccatgctatcggtcagaaaggacgactctgagagtagaatcaatgaatatgcagatgacattgattgagtagatctgttcgctagcccgcgataccattgggttagtttgtgttactttgcaacacagacgggactctagagattggcaatctttagaccc

SEQ ID NO: 622 - DNA, 5310 bp, Unknown
  derived from dsRNAs of unknown virus
cgataaaaagttagattatgcaacgcaagacggaacatgatgataatgataagcaagttatcaagagtaataacttagctgagtctaaacaaggcatattcaaatcctttaagacgactcgaaaaatattaggtgaagagattatacctgacctaacatccagatttggcattgcagagtcaatgtttgaaaaatatggagtccatgcaattcacgcaccccccttttcgggcaaaacttggttttgcagtcagggatataataaagagtgctttaaagtttatgacattgacactttcatattgcaagaggctgcagaccggattggtagtattgaagaactgcagattaaatatcctggcacgccctttgatgcatttaggcaggacctgtttcatacaaacaatgaatgcgttgtaatgctcattgccattcaggcaattattaagaatcacggtgttgaagggggtaacttagccatcttgctgccgaattacggtcgcgaagcaatggcgtatctccactggtcaggcattacacataatattatggttctacctacgattgaaaaaatggatgagtgggctgtgttgtcacacaactggcgtaaggaccgctattctattaaatccataaggaatgattgccacgctgcagctgctgaggttgcagagtcattcggcatacatatcaatcaaacagttcgagaggcagtagtatttatgttgatgcagggggctgaacttctgacggatgctatgtatgatgagttggtcagactcagtggcagtaacaaaaaacgttgctctgtagcggctggcagtgtcatggccctgtttcaactgattgagaaaggtgttacaacctacagtcatagcggcccacggacatttaaacgtcgcaatggtatttctagcacgccgacatttgcatttcagggttcgcgtgagttcttaacgaaagtggtggataatatacgagctggctcgtctgtagttgacgaggttatggctgcacacacacctatacagtcgagcatgaactatcttaccaggttaatcactggatcacatgccctagccaaggtcgagccagcttcggatagccagcttgacaacgacatacccccgtctagagaggattcaaccgatttacaggctgagcaagcagttgatactactgctgctgttagtgcagaaactgttggtataactggcgccagcagtgcagccaaacattggcacattgctaaaactgcttattacctagaacttttgaagaacagcacgactagcaattcggaagacccaactcccgatttggtacctacaggactttttgagcctgacatcgcaactgcttcagctgacagtaccactagtgatgagaacatgaaagaaccggaaccacagccagatgaggcaccagactctgagtttcaccagcctctcaacgatgagagggagttgcctccaggtgatgaacctgtttactttgatgcgacacgactggctgcggggattaaacagcgcaaccctgtgcgtttacaccagagtgaatactactcatattctgaggtgtatcctgacgcatcacaggagggcagccctaatagtactttggagtatatgaaaggcacattcccaggtaatgatgacgagagagtcgacttcattgacggttatgacaacaacgatgaatggttagaaatggttgagattgctagcaggcagaaggctatcaccattcctgactgggctgaatacggccgacaatggatacagaagagtgttatcgaaactggagttgatactccaatggcacaggatatgtcaggtgcagttgattgggttcgtaccaatgtaccagctcttatgggcgaaatacgggataagtaccataatgaggcacggccagcgtacataaattggcttcgagggctgtggcaagataagcgcataccaaccactgtctattggggtctactgcctgagggtgctattgataaactacccagaaaggaggctattgctatcactggcaagagcaattgggctgattggcttatgtctatcaaagaaaatcaaggcaaatttaacagcatgttttgccaagaagtttatgcggcattaaagagtacaaaaagcgatatgattaaagaaatagcacaacgctttgaatttgcacacacgaccgccgctaaaaaagcgaatataaccttacaatcaatgctcgataaaatacgcactgacagctgcgattacatgaagaggtcagtttccgcacttctgggctttcacgggcctaagtataacatactacgtaagcagtcaaacagttttatagtttgtatgctaatatggatattcggcaatggattgcgtgcagacttattcgcacaagtggttgccactggaatatttactatacaaagagataagtggtctgacatcgccaaggagatgcacacattagtgcactcgtcatgcacaatgctgggtgttagattaactcccagtgaatgttcagagttaatgtattttgacatcctgtatggccgttctggtgagacaccaaattggcacgatgcaagggtggccagatccgtggtaccggtgcctaaagttgtgtattctgagaaaaccaaaaactgggagtcaagcgattgggagcgctgcagggatgcaaaactgtacgagattattgcccccgcagttgctgctgccgcagaaaagggcattcccactctcaaggagtgggtttcacagcgccacaaattcggtgcaggtggcacggcttctggtttaccgacaagatacaaatcaaaacatgttggggacgttttcttggacactacagtattcactgagaaagatcttgaatccaaaatgaactggttgaagaagggcattatggagcatgatgatctgttagagtggatggaacgcagaatggacggtagcgacacaggcatgagtgaagaagtgcttggcagggttactcaagccataggcgaactaccgccgatatacaatatagtatctgcagctggtaagcctgaagagcttggcaataaagttcgagagttatacgcctcatatatggcagactacttattgcagaactacgtgctaagtgtttttgagaagctcattgaccacccagacgttgacttaggctctgctgatgacggccagattaatagggatttggaaatcattgccgagaacggaaagggcttcaagctatgctgggattacgcagacttcaacatgcagcataccggtttagatatgcaggcgttcttcaccacagtacaggaagctgctcgcacacataaggcaccaaacgattttgtccgggtagctcagtgggttggccggtctatgttaaacacactgatattattcccagataaggacgtcgacccactgcttgtccatgacacgctaatgtctggttggcgaggcaccactgtgctaaacacatgtctgaatgcatgttacttacacggaatggaagttagctaccaggcgtattacagtactggcaagcagctgcttcagtttagaaaagccaatggtgatgacgttattgcacgcgtagaagactggggtcaggggttagcatttctcgaacttgctgaaaaattcaatataattggcaagcttgtgaagcaacggcttgacccatatgatggtgagtacttaagagtatcttactataaaaacaggcatgcgcgtacaagcatgtgccgggggatagcaacgctagtcactggtaactggattggtacaggtcattcaaatttgattggcatgaaggaacagatagcaaaccaaatggctcttatgcggaggcgagggttgaacagtgctaccgcttggctttgcgagaaaatcctaaggaagaagcacatggtgataatgtgtggacagggtttagcaaagggcggtattgtgtacgcacctagtggttcaggcaaatccacattcgtaaagatgaatatgggtaggcttggcgaggtcatattggttgacggggacaagtacgtcgactggtacaaagctatgaaagccaagcaaaccgtaacagaggccgccaacctgataaaggcgtggttggactttgatagggaagataaatttataatacttgtgcatccatgcgccacagcgcttggtttagataaagtgccttcagtcgtcgtcatacctaacgaagtcgaattggcacgaaacctgaaagcaagaactaagcagttgggtcgcaattcgaccttgacagcgaaaggcatgagacaaacagcctacgagtttgctatgatgagaggcttaaacataatgggcaccttgtatgacggatgcaacagcgtagcacagcagcttggagatgattataaattcatgctgcgcgtaccagattgggtgtataaggtgagtcgggctagcaacgggtggggcacgaacggtgtaactgtcttacgcgataagctgccagactacccaggcataaccaaatatgtaccgagattgagtgaagccattcccagggacatgagtgacaatgaagtcaatgagctgcagcgtgagctgttttccagagggtatggtgtggttaaacctaaagaattggtggacaagttggcagtcgacaattatatgactagcttgaataatagtttgaacagcaagctcgagcgtgaagacttgagcggagctgttgaatggtggctgcaggttatgcagatagagccaatggtgcaatatgaggcatatccagatctggagcccgacactgaagcgttggcaaatgctgcggtagaaaggattgcggtggccatcacgacgggcaaattaagaacggcagaatacataaacaaggagatgacaaagggtgaaaggttcaccagatttgaggggtatatcacaagaatatcaaatagcgaagcggcgagcattgtagagatagctcgcatgcggcctgaagtgtttgggcttaatgcaacattgcttgaggcggtgctgaaggataagtgggtggacaacgtagcagcctcacaggtaccagcaaattgggccccagaaattagtaatattgcaatggagctgtacagaatgcagtacgggttgcctgagaacgtgaccgaatacaactacaatataagtatattagtgtattggctggggcggaaggtggcagaacatgaccttttgaagaatttggttaaatattaacaaactacaactgacaattagtcagaatcgagatttatagcataaaaccctggaggggaagaagagaatatcg

SEQ ID NO: 623 - DNA, 5176 bp, Unknown
  derived from dsRNAs of unknown virus
gtaatgaaatggaaggatttgtttaaggtcctcttttgttgccgtctgattggtgaatcacatgaaaaataaaaaacaaaacaaatacacaaaaggtaagcaaacagctaagtcaggtcgtactgatgaggctgggaaagggtttcgacctgcttcagctaacctccacgcccgtaaggcaaacctgtccggtgttaagtcaaggaacatgtcaatttcgaacattcctaaccaacgccccggatatgcataccttatggaagtgggaacctcggaaatgttcaattcgttgaacagtggtatcagttccaactggttgcacacaatgatgaatctcatcactcgtggcgaccgtgagttgaacgaagtgatggcattgtacaatgttggacgaactgaggagtcgcgagaagcgatgactgtacgccttggccttcaacgtccaatgtgctatcaaacccgaggccgcaatatgttttataacaggccaaatggaaacatgatctcaacagacattactccatttgactgcattgtggcaatcgaggagtggcacaaggaatggtcacgcgagataggcatgcacgttaagatgctggaacattgtatccaagtatcacgtgcgttccacgctcaacgtgatttcgggccatatggtgtgtcggaccgtcatttcaaaaagaacggtaatccgctcaccccgtacgagcatctgtactatgagttaatggaacaaatggacgaccctgtcgacctaaacgtaccagctcatctcgtggctaatttgactttggaagatctagcggtgtactctttggctctactcgctccgacttccgcaggaatggtcaacgatcattggactttctccgcccacacgaacatccactacgaaggctacatggctggatataatggactggactttgggctctgcactgacaacgacggtaagcctcgctatctcgtccaaccaccagccactaaggttgaagctcgtacatctgacgacatggaacaatcggttatcaaatcggttaccatggcgactgacaaactatttgtcaaggtagacggactacattccctcgagggcgcaagtcttaaggacctgcctcttggttcagcaatgaacatgttggcctatggtgttaaccctgctgaattcagtggtgacgtaaagttcccgcttaattggcagagtacgttgggcggaattggcattggtaacatcgtgctgcctgacggacagatatccgatccaactgtgaacccggtttcggccgcaagtgcacagttcggtttggctcgccacttccctctgactggttcgctctcgtcctggattctatccagcgaaaagagcacatacgataagccaacgctacgtatgatgccaagtccttcggaattcaaggcgtccgtcgcacagttgtcagcattactcgaccaacttcaggaccctgacgtcaccagtatggaagcacatactgaggagtcaattaacttccttctttaccaacgcttcggtcttggtcttggggacgataatgggggaatatttgacaacgctttatcacgagaagaggagctggccatcataggtaacccgcaaccgggcgatctgtacatgccatctactgttaacgtggaagttgtttccaaactactgacgtctgcaattgactcccgcaaaacactgaaactgtggacctcgaagacgagcgaacttgtcggctggtgtaagctagtcgctgacgttttgcctccggcttacttggctacaggctacaatcagctaacggagatcaagagcggaggagtactgcaggtaggagagcagttcaacatgaatcgtgtcactgacatgattaatttgggctcaacttaccgaccaaagttcaatccgatcaagaacatcgatgcaaacaacggacccttctgggaccaagcaaatctggaaagagattggctatcagccgatttctcttccggcgacttttccgaccaactcgaagcacttgaatccgtattcacgggccagaccatcggccacggtatcggacaaggtgggatcacgctagcgcaacttttcgctgccatgaacccacgatggtgtgatgcactctggaatttcaactcggcttcaagcctgtccaagcacgaagatacgtgcctgtacctgctaaccgcgttgacgccagtgttacattcgctaccgctgagggtgaaacgaaattcgctcacatggagatgctgatctaccggctatttggtacatttagatgcaatactactgcacctttggctgatatcgactacaccaaacttggtaactcggaacgccttctacaaggcagcctgggttataatgtcaatggtataccgcttgaacgtgcggcggaaacgcttgcactgatgcaccccgatcacagtgaagaggacgatggcccaattggcgaccttcctctcattgacaacgctcacgtcggtgacgtgcagtccggagtgacagctgtgttcaacggtttcggaatggcctacaatcaggtctatccgaaccatgatttcaatggcatgggtgtggagattgcctgggacgctgataagcgtgacagtgagttagatttctcattcacagaaggaaccacaacgaccaacgaaaccggtgaaaccatcaccgggttcaggactaccaccaaaacgttgacaactaacgccgcttcagttatgaacgccagactccgtggtttaaccaccggaatgtctgcacaaaatgttcatatatcaaagaaggtcgggacaacccaagctacctccaatggagcattcgctacggacatccgattttccgatgaaggcaagtcagccgacttggagatcagcgtgccagtacaccggcatgctgtgaatgttgtatcaccatacttcacttacgcttatccagctggaagtatgtacatggcccacaatgttaagctaaaggatatcgctacagtagcggtcttgaagcctagcccgaccggtgccgcttacaaatcattcagaagcaaggttgaaaagctatctgtcggttccctcggaattgacacggctgcccttgattctatcgacaagcttaaggctgcactgcaaggctgtaaggtaaagatcaccgtgcacaaagctaccgtagaaaagggatacgcaaatctgtccgcagatcacagcgtcactttgcccaacattcttaacggtggcgacgatatcgcaggaacaactatccacttcgcactctacgagtttgaaggggtcgattccagaccaaatgtgctactcccccgttggagctggccattctggtatcgtagctgcaaacggttggcctttatacgaggctgttgacggggtccccagcggtgctttgccgcaagtaatgaattgggcgctcatcacgagcttccctatggtgctcaccgctaacgtaggtgtgcactatggtaacattgcttcgcacttcaatgcacaagccggaggagctgttctggacgtcggctcagacgacgaaatagatgcgagcggttacttgctcccagagaatgaagacatttggtatgaacagaggctccacgagctgactgcagccatcctgtcctattccgaaggaatgtaccatccaactgttttgtcgactaagcctgagcgtgacttgtacccgtaccaccgtgagctgactggcttccgccgtgcgttgatccaggagttaactcctgaattgacaaagctgcaccgcctatcagtctcaccatttgccactgacaacaagaatcttcttcgcgttgtcaaatcgatatatgttcaaactgaatatatgtttggttacacggcattggcacaggcagcaggcccgttgtacactcaaatgtcaaaagaggcccttctaaatgcacaagatgtattggtcagaagtggtcaaattggcagatagttacaacccgctttctaacgacgatctaccgttaaatgccgcgcttgccatggttggagcagttccagccacggccgttgcagtttaccggcactcacccgcactgattgctttccttatgaagcaaccggcttttctaagccacgttgctaaggcagcaggtcctggattcctaagcacgttagtcgcacgtaatacgtacggcgaagcggaagctaggggtcaagacggatttactgccggtcttgcttccaccgccgctcaacttgagttaggtagtgtaagcactggaaacacagtgttgccgaaaggcccatctcaactagcaaaggctggacgaggcggtgctgctatgacacgccacatgcgtgacattgctagtgctgtcgctaagcctacgcgtggtgcggtgataaaagccgttaaggcccccgtgaaaataggggctggagcggtcaagggtgtcgctggtctagctaatgcaggcaagggattaggtaggggactaggaattgaagcagcaggtaccgccctaggtggtgccgtgcttcaaggattgagtaggacaggcgtattggaagatactttcgatgccctgggcgctgatatttcgcaagaagacattcagcgtcacgtagatgactttaccactaccgaaatcggtggtgttactgttccaaacgtcgacccaatcaattcggtcctcaaaaccactggagctattcaggatttacatgacgtaaaccaagaccgtggctatcacggtgatgacgcctacagcacaggaaaattcgtccacgacgagatttctgaagagctgggggatggcattatcggtcacgcagttggtggcaccgcaggcttagttgtcggcggggttactggcgctggaaacgtcctaaaggatctgtggccgctatgagcgacacagagattgatcttgatggtgacggagtagcggatatcgtaataaaggacacaaacggtcatacgccatacattaacgtgaaagtgttagtcaaatgggttgttgggattctgacagccatgtctagcgcagtgatcggtgtggcagcattgctatagggcttaaccagcctcagcacacaggtgaacatgtgtgcgatgactcgaataaggtgcatgatggcgccttagcatcttcaagggatgttaaccttgaagataacttaaagcagttcactgcac

SEQ ID NO: 624 - DNA, 4904 bp, Unknown
  derived from dsRNAs of unknown virus
tgacaaaatcaacgtgtgttgttccccgttggtttgcagacagatagaacaaacccaatacaagaatgcagaatgaagcgaacgcgatctttggggacgcgacatcaggctacacaagatcagccgcaacactcggaagctacgatgtatcatcgaccacggtcgccaaactcgagtctggcaactcaaaattcgaaacatcaatcaacagctcagtcacattcaccgccacaggcattaatgtcacgctcgagaaagcaggtggctacgcagattaccgaggcatcaacactgagctcatcagcacggctgggcgtgttgatatcgagaaactcaagaaagtcattggaactaacaaaggaattgatgcagcaaatcaacgaaattacatccagtctctcgactctgcaaacacaagtgactcgcatcacgcaatcatcctcacaatgttgcaatcatacattaacgcagcaattagagactcaacagagcaaacacgacaaaatatcggaccaggttacgatgcgtcaggccgtcagggaacttaccttaacccaggcggagatcttggacgcaatacaatcaatcttggacaaaatgcaggcacaacgagcctcttgctcaaggactacagagatagccacgtcatcatgtcctccgaagacgacggaccatgtttcaagcgcgtttcacagccaattggaccgcctaacgacctcaatccttcaggtgatggggatgatcgcccagcagaacataacccagcaaatcttggagcggcagatcactcaaatgttatcttcattccatggcttggaccaaaagctaacacgttctatctgctccacgcagcaggacgtcaaaacgctgatgggagcaacgcaaattacatgtacaacacgccaggtattgcaatcaaccggttcgtgttccgctgggacaatggaacccacaacgacgcaggcgactatgctgacccagatgaagtcgactggacccaacccgacaccatgtgggcctacatcatcgcatatgtcaaactaaaccgtgttgaacacacactcgcgcatgtccatgagattatcgccagaacaactttctatcctgaatcagccagtgcggaaggttggacttacaaatcagctggacttaacgtctttattccggctccggcgtacttccgtggtaagtacgagcccctgctcaaaggagagccattcaagttggatgccgtaggcatggaattgacttttcttgatcaaactactgcgctcaaagaaattatggtgggtgggttgatcaactacacctctttgattggtctgtggagcatcttcttcgaatacacacttcattacaacgatctgaacgtggcttacgcacattgtaatgctcagtacccaatgttggcggaaccgcattcacaaatggccttcggagtaggcgctttgactggtcgtgacccgttgacacttttcgaacccggaattggagtcacatacaatatgagacagtacatgatgggcggtctgtacccgtacgtgcgaccgtcttctaagacttctgatttatccgacttcgtaattgaagatcttcgactcaacactgaaggagtttttcattgtcctgtttcaccctgtttgatatatggaaaagctgctgacatgttaactggctgtgcacactgtacggacggttttaaaatgtccgagctccacgctgatatcactcttgatttcaaagacgcgttacgcctcacgaacgcatacaggctattcgggcgcgacgttactttaatgcaaacgtcaggaccacaagaggagttcactccttggtcaccagcccacatggtaggcatccagcctaattcaattgcacatgatgccacatttaacacgcagtatattgtggtcggaagttcgcaacgcgaaaattatggggcgcgagtatcaggcgtcgaagacggtctccacagtggcaagatcgaactgtcaatcaatgtcacatcaatcaaatttaacatggcgatcagcgcacggcactctgctcacacaatatatcgcaaaaatagaccactacctaacatagcaattaaagtcgttgctggtggtgtgatttctgctaagattgctgcagtacctaataccaagcaaaaacccgtagacgcgggtacgcaggattttggccaaggggagcagcagcagccggggatcccccaacaggcgctggagaatgcagaagcagcacagggaactttagtaccggaagagccgacgacggtctaagcggtaaatacgcacgcaaaggcgggattaaggtagttgatagtctgtaccatagcctagcggagaggggcttggtctacacaaatatgatggttaatcaagactttgaagacacgggtatagtgacgacagtgagttacgaggaacaggacataataacgaaaaacaagaagccatacaataggacaatgacacacaattttgtaccaagatacatgcgagtaagtaagaaaaagaatatatacttaacaggtttagccgaagccgactacgtatttgttacagtaagaaacaggtcaactgacgaaacaggggaggcgtcgtggacttggagagggatggtaatgcacggatacatacttaaattaggtagggcgagttacatgtacatgtcaacaaaagatataataacaggatcaccttacgttaagtcgacaatagcgtcgtacgcagtagtgggtatgacagattactactataacgacccgactaacataaagaacctggagttacacttcggaaccagcaacagtcacaacagtcctagtaaaagagatatagaacacttaattagcttaccgacgtctaagatcactggggaacaccacacacactacaatgtagctgaaatgctcttagcctttaagggacagcaccacgacaaggtaactactgctatatccaaaatgacgaatgcaacacaagcttttgcatcgggcacactaggatggtactggagcttaccggttgacctgaaagccatagtgcgagaagcagacatgtggaacgaaactactgtagaggactgggcaaagaaagcgaaatacgcttcacgtttttgcaaagcaatgcaaaactgcatcgaagctgacttacgacctttgtttgaaatagacgtgctgtctaatagagggatcggcgaaatcaactgggtggcagaaaaggagcacagagtaaagccagacaccgtaaacgttacgtacgaagaagtttacaaagaagcatcaatcgtattcaatagggcacaaatcgaaggcagatcaccaccacgtatgtcatgggaaacgtactggaataacagatggcaatacactccgaccgggtcaattcactcacaatgtgatgaagatgcacaatacattttcaaggaaagaaacattaaaaataagtttatgacattgataaggatgccgaactcgacgacactgtcttacttcaccggacgtaaccctgagactcatgcgtggtcatcagataaatgggaatggggaaagaaacgtgctatatacggcgtcgacctcacaactttcgtactaacaaattttggcatgcatatgtgtgaagaagttttgccaggtgacttcccggtgggttctaagtcgaatgatgactatgtgtcagcagctgtcaatgaagtattaagggataacagtccgtacgccttcgattttgctgatttcaacgcgcaacacaaaactggcgcgatgaaagccgtaatacacgcatttcgtgatgtatttgcaggtaaactgacagatgaacagatcgaggcaataaattgggtacatgcggcacataacactgtatggatacatgataacatgggcctgaaggagacgtacaaaagtaatggaacactactaagtggtcataggctcacgacatttatcaattcaaccctcaataaggtatacagtaagaaattaatagagggttcacataggtacgtaaaatctgtccataacggcgatgacatactttttgggataagatcaatttcagaatgttctttaatgaggcgtaatgcgtttaaatataatatcagagcacaacaagccaaatgcgctgcctttggcatcgcagaattcttacgcgttgatcacacaagaaaaggaaacggacagtatttaactagaggcatggcaacgttagtgcacagcagaatagagtcatcagggggtaaaaacatatctgattcacttgaggcaaatgaaatgaggctgttagaagcaacagacagaggcttaaccaaaagcgcggccgaaatgttaaggtacttgtacaataaacgggtatcagcaatatttgaacatacgacagaagacgcgtatgtcatagttaatacacatcgcgcactaggagggcttagttcagggaataaagcactactagaacatgacatagaaaacgtgttacttgaacaaggtgacatagaagaactggaaggtgtttcgttacctggcatcgcagcatttgctaatgccacggcaagcaggcttgatctacctgagaagagagaacagattacaaaagcaattacacaagctacacttacgatggctttgccccggaggaccggaaaagccatcactaagattaccaatcgtggtgaatctttaatcaaggtaggcttgtacaaatgcttcaaagacctaagagcgaaagcgactttcgggcaagctaagatggcgggcgtagtgctcgcactcaatagcgatgacgaccggatcgaactacttaaaatgacaatatcaaaagttgaagatccgattaaatggttatcactgctcgtttagacgttatagctaaaggcaagaaatgggcacacgtccatcagca

SEQ ID NO: 625 - DNA, 4715 bp, Unknown
  derived from dsRNAs of unknown virus
gaatctttttactacttagataagtttatgatttaaataaattttaaatgttgaataaaaatgatatttgtcgagaacatttatttagaaaatttaattcattacatgaacttgtggaaaagagcgcatccgtattgaacgctgtaaatgtaagtggaagaaaaatcattgatacaacacagttaacggccgtgaaaaagagttgtgaaattgtaaaacacattttgaatagtcttacggatgaacaagtttcatccattaaagccatggtgtatgatacaataaaggtgtggtgtaaacatgatcaagaaccgcttgatatagtcggatccaaaaggttgccagcactaattcgtggaagaccgcagggtattaaaattggaaaacaaggtaaacaaactgaggaaatgaagcttgaagaaaaactgctttcacttggtgagtttggtccaatgaatccaatcgcgttatttacaaattatggtatgtcgcaattatatgaggcgaattttattgatagcgaagtaaagaattcatacatgagtagcattgttacgttaatcccaaagggtacggcaccgacagtcagaaatgatgatagtgtctattgttatgtggatgaaattacaatgaatgaaagtggaactgaaccaaaaatgatgtgttttagaaaaagagataaaataatccatatgacgtgtatgccgcgtaatgtgccccaaccgatggcgggtgaagatccatttccagctaatcattacatgataggtgtaactttttcagcaccattatctgatagatatttcaatgaagttaagaaatacacgccctttcatctttacaaagagtatgtctcacgactgtttgtaattcgtgaaatgttacgcatcacgtctacaagtcctgttccacttccatttacaaaagttgttgaatttaagaattatgtatacggaccagatctttatcaaaaatttaatgattttggtggcattgaattgataacaggacttgtatatcaagcatgtgagtgggccggagtgtcagccaaatcaaaaggtaagaatgatgatgaacctgatattggtgattttcttgatgcttggttaaataacgaaactcaattccgtggtccacacttcgtgaggaagtggagagagaatggaggtgcacgaagtgcaagctacattacaccttacgacattggttatgaacaaggaactgtaaaaggaatacatgcacaatcaatggaaatgctttttaagcaaagggataaattaaaagccgtaggtgcgaaactcaatataacgccacttcctggagttgaaacagaccaaacatacttacttcaacctgccgcaacgtcaacacatgcataccatagaatgttcgcatgcttaactgcttcaatatatgtttcaggaatcagtgatttacctgggctgacaacattgtaccgtggtgcactgaaagcagttgggagagatataaatggaagggtgaagaaagtggataaagtctgcgggaaacttgctagattattaatgtcattaagaaagactgaaatacctgctgataatgctgaaattccacttccaactgcgaacattaacacaccatttgaaccaagacttgaaatgaaagaggtgtatgacatgacatctgaagtcatatttgcaacaaaggcgcttaagcttgcgcatccatacataaaatacagtgtgggttacgaattcacggcgaaagcgcatggtggatatagaaaagtgattcttaacgccattgctgacctcgatgagggatttcttgttgaaggacttagagaaatattcgaatactgggatggttcaataggtgataatcttgataaacacgccatacatggtatgaacaatagcatgctacgtgtccttacagcgcttcaaaggcctggtttaattggaggattcaaccaaatgggcaaagagatttatccaggtctatcaagagcggaaaagattgccaaacatgatatcgatagtgatgtttacagtgatggttatgaaagaatgttcatcaaagagcttaaagccaatttcagtaatataagaacaccagcgataagcgacctaattgaacattccagaaaagcaatgaagtcagcctctgcaggtggagataacattagtgtacgcgatgtgcttacagaaaatgtattgagagattcaagtcgtcaggaaaagatgaatgttgtgttaaaatcaaagattgctttgcctggtgtgttgccaacgctctttctacctcgtccaggtacaacatcagaagagggcaagtttgaaataaatagattatcaacacccacacgtccatacccagagggtacaagacgtgtaccaggtgaaaaagatgatcgtagtgttaagaattttgcgactggatgccaaatacttcttggaccattatatgatgccatgactgcatttcaggcgctacccgaaaatgaagcttacctactggcacacaatagtggaatagttggtaaagatgcagcaagatttatgcgtgattcattacgaatgacggttaatgctctgtatattgaaggtgcttatgattacaaaacctttgatcaattttatggtagagctgcttggaatgcatacgttaaggcattaactgaaacattaattggtacacatcctgacttctcacaacagtttaaacgtgactacaaggatatgataatagaaataatcgaatcgtttaaggatggttattatgtctatcgtccatttggtggtccacctgaggtaatccacacttctggaatgccctcaggtgttaaattcacagctccaggtaatactataaagacttcagcaaatatcaaatatgctgctgaaaaggttcttccttcatatgaagcgagtatgcatagttatggaacatggggtgatgatgctaaggttcaatttgaactatctgaaatgtcattcgaaagagtaattagtatgattgatgagttcggtgcatgttcaagggaagctgctcaagtatgggatacgggtgaagacactacaattggaagagtggttgatattctacgtacgtactacattgacggtcaaatgattaaaagatttatgccatacgattcagagcacccagtaattcttgattgtccaggtgacatttcaccaatattaacaaacattgtggatatggccacacgtggattgaatcagacctcactcatgttaatgatgtactcattgttaattatgggaagaactgattctgtatttggatatagttttactttcaatttctttgatatgataatgcctggtggtttaactggtattatgccagctggctttccacaagcagcatccacaaattacatgcgtataatgtgtagcgaaatgtatggatcaagactcataatttcaagaccacgcttagaagaaacatatttacttggaagaagaatgttatttccagaaagatttactaattctggaggtgcggatccaaacattagagcaacagtgggtggtactgtttttggtatgacacgttcttcaatgatcgagtcatcgaatagattattgaacgatactgatcgtatttatactagggataaccttacagcccagccagctcaattagataaactcataagatatgagaagtatgtattgtcacaaggttccgaaacaagtagattaagtggagttgaacgcttagatcaactaaagtacacttcacacgttactaatcaattatctgcaggtctaggaacttcagtacttaacggtcatttaagaaatcaatacattcagactaatatggaaagattaggattgattaatgcacgtaataacggtgttccagctgagccagaaagagagagcgtatcattgttagataaagtaattaattttgaaaattactcaattctgtttacgatcggtggaaattcagtttcaggtgttgagaaatattcaagtctggataagtataatgcgttatacgaattgaaaattcctaacgagagggaagaaccatacattattgtaaggacaactgaaagtgaatttagacaggaggttctatcacttaatcgatgctactcaggattcttatatatgccacatgtatttagaatccttactggtttgttcggtatgcagacatcccgtaattcattaaagttaaggatggaacttgttgaatttgatgcttcatttcgtaaagacatgatctcgtccgaacaagtgctggacatgataaatgacttacttcacgatagagaaaataatgatcttgttgaaaccatgttgcgatacattggttttacacactttgaggctgcaaatcttttacagaaaagagcaaggataccaatcattaaagaaaagcttgaaatgaacgaatatacatcaaatcctgatgttttaaagtcactctcactaacacgattaaataaactatttagtatcatattggataataatacttacacatacataaacgacagcgaagacgatggtctgaaagagaatgtatataaatactacatttctctgttgtacgatcagataaatatagcctgcgagttaagtccacccgcaggtgaacatttatacgtaccactcccagaagtcgtcatcgaaagacgcgtgcgcaccacaagttctaaacaaatctaaaagggtaagaaaaagctc

SEQ ID NO: 626 - DNA, 4509 bp, Unknown
  derived from dsRNAs of unknown virus
gaaacatgaacgagtttgcagtcatagtccgggcacgtagcggttagacggggcaaatgcttacctgtcttcctgaaggctgaaaagttagtaggggaataaacaaagcattcgcgacgatcgtgctctagtaacacacatggatatattggcgaggctccctagtggggaagaactcaatgccgattcgtttcataaatttaagaccacggttccccgcttagaaatcggagtacaacatttagtttccgcaactttttgcggctgtcccacatctggacaagcagacgtgcattacatcattgagtgtcataagcgtgctggtgacttgtcgaacctgctcagggtgacatcgacaatccctcctattggctcacagtcttctgaacagctaaaggagatgatcgataaagttcgtccccggactggttatgatctcagtgcttttactactcactcattcgacttccgtgctttatcgtatatctgtggccagatcgcctgcttggcggcgactggcatagataacgatttgagtcgcgacggttcggctaaatgcacctccatcggccagatctggaacaatcctaacggcggcgatatcatggtgccgccaaacgtcattttcaagagcggagagtgggccactttggcttgcatcgccaaattagctaaatgtgacactctcactttcctcagtgatgttctacccccgcaggaatctaggcaactgcagggtaagagtctctgtgtgttcctgctccgattacacgcttgtatcttgtcttccgcagatgggatggggtgcgcagcacaccatgacgaggctttttttcgcggtatgtgttcggcttggacgttgtggggccactctgatgagggagggtgggctcggaattatcttgccaaggccgactaccctcgccctcgcgggttattagctcccacctctactaccgtttgtggccttccagtcatgcaaaacgtcagtcttaacgcaggtactcgctggtgtgtcgcgctcatgttgcgcggagcggggatctggtctgcagtcgacaaacccatgcagggggtttgtacagctatggcgggtgtacaggatgctgatgaaggtcctgcacaaattgctgggttgcaacagctctctgcccgacacctcgagctctggcgacgtaaggtagaagaaattgagcgctacattccttcccccgtgtttgacgaggcctcccatatcagcttctggcgtgacaacagtgctgacagccgccatctgtaccacgaagtgattttcccgtttttttgggtggaaccttctccgatcatggactatggcgaaaccgccatttacatgccttgcgtcccccttaaggcggtcgaactggagatgtttccgaaaagtaaatccttcaaaaagagtcgtaactaccccgacaactgcacggttcccccaaggggcagtgcgactctcatagctgttgatggtttcgaggcccggcgtagcggttcgcaatatattctcagcggacgttaccgccgggcagacggtcttggagcactagtcgaagtgccctccgcccacttcgcgactgacggcaactccctacttttcagtggacaatccgacgtattttctcagaagcgttggatcactccacataaccctatggcacaccccgcagagtgccgtggggccacaagcactctaatgactttccggcatagctctggagacgggtacactcgcaacgccatggcttaccctaatttcgaggaccttcaaggcagtgtccgatcagtcgttggtgacttttcggttgtcgccccctcctcggaaacgcttgctgccgcttctcatcgcgatgttccgcgagcattgcggcgcgaattgctgcgcaccctctccatgggggattacggcgaggacgtcatgtccaaccagttcgaggaagttgaaatctttcctcacatttccgctacatctattgcccctccgccggacacggagggtgccgactcctccttgacctacgcatctgctcctaaagacgattttgggcctgaagtcaaagtcgaactgctcggttcgactggggttgtccccaaacaaccagtccgtactttagatgatgtggcttcaaaagctgccctcttgggctcggagtagggtggtcggtcagggacattctccttcgcttcgggagattatggtaactgaaaaggctttgtctgcgaatgacagcagtctgggggcttggttcgctcttaatgcgtggcacacccctgtacagcttgagaaaacagacaagttatctttcgaagaactggcgaatgtccttgacctggaggtgaaagtagcggaaattgggaagcagggtgccggcctggctttctacgaaaaaataagaaatgatgatcgaaagttttatcccctcaaacaacacataggagctcagaccaaagtaaacgttttctttagggacgtatttagagatgtggtggaatatcacgaggacgtgtcagatctctgggttagtctaggtacggatggcttcttcaatgacgaagctagcgggtggttgatgtggttggtcgtagcaaagcaggttgtaggtctggagagagcagctaaatttttctcgttactgagggacgaagattcggccaaggtcatctcgaatgctgttaaaggtctaggtctcactactaccggatgggggtcgctggtctgcgaaattaattgcctaaaaggtcgcggagtgggggagccttcgccaaatgaggacgttaaagcccgaatcgatgcaaaagaattcataggaaataaaagctgtggtattggtgaggagataagacctatggtaagacgagtcatagcctcggaaatgctcaagactcctgtctggaaaagcaaagaggatgtttgggatcgtaggtggttgactacgaaggcgggggctcacagtcaattttttgagactaaagctctggggggcaaacttaaccttcctgagctgcccacgaggagggagttctccgagaactgtaaagataacatgattgcttacggttctccgatcgttgaggcagggctgagctggaaattagaacacggcaagacgcgtgccatatacagctgtgacacgcgatcttacttcacattcgattacctcctgaagccagttgaagaggtttggtccaaccgagccaccctactcaaccctgggaagaatcgtgaggatgtcttatacaagaaaatatcgggggccggagaatgtaaggtgatgcttgactacgatgactttaatagccaacattccatagaagcgatgcaagtggtaattgaggaggcaaccatcggcgctccagcggaaataagagaatgggcggtagagtcactacagaatatgtacgtgcactggcatgacggggaaagtttgaaacgagagagaatggttggtaccctacctagcggtcatcgtgcaactacttttatcaacacgatccttaatacggcctacatctggcatgtgaacggcggccccccagaacttgatatgctacataccggggatgatgtcgttggttcgggcactgttgagaattgtgagaagctgatgcaaacagtcctgggatcatcgctgaggactaatgtatccaagcaagccataggtcgtcggggggagttcttaagggctggatttaacaacgacttggcgcgcggttatgtgccgagggcgataagctccctggtgagcggtaattggttgacgttaggtactaacagtaaagtgtctttcgtcaacagcgtcctcggggcttgttggaatgttgcagtgaggtcccagttccgcgaaatagggctcctcttacgtaccactttcgagcgccgtgtcgaagaactgggggtatacacttgtccactcctcaccttcaaaatatcatttgatggcaccccagtatggtcagcgagtaagtataaaggactgatgttgcggtattcagaagggggaataaggaaagttagagttagaagcgggaagtctcatgccacgaacgattatttgaataagttcgtgaacaacgaagttctgcagatgtttggggtgaagaggagtgacgtgaagcgcgtgatgctagcagcatcttacaaaccgcgtgaggaaggctcccctaagctgcgaatcgtggctgttccccatgacgctcctctgccgattagagaggacttcaggctaagagctgttgctcgtgaagaatttgccactacttttctgtcagggaaatcgctcagttccgaggagcgacagtgcctgagagcgctcactgctacggcgggtacgaaggtcctgcagcggtggcccataagttgccttggccgactgacttggcagattctgaaccaaatggccagtatcataacgacaccggctgtcgtgacaccccactacgcggtgttgaagtgaaccccgacccctgagcgggggtgagcttttaaataatgttttt

SEQ ID NO: 627 - DNA, 4328 bp, Unknown
  derived from dsRNAs of unknown virus
gaatttcattgtcacgatcaattttaagtgagtcgagagtatgatgtccattacggagacacaagctcagatgaacgaaaaagtcagacagagataccagacattgcgttccatggttgagacggtaggtaccgaagcgagaccaaaggggaaggatgtgatgcgtgaagtcgatatcagtcaaatggtacggatggagcgtgttggtcgtttctttctcaacatactcagggatcatcccgaagcgggaaaccaagctatggagatgattcgaggatgggcagctgcagacagggagggttcacgtagcaatccagtcaacaacgacttctttccagtagtcatccgaggtcatggagaaaaagagttcccactatatcacccgcctgccgttctgacacaagcgggaatggaccatctcctccgaattggagccattgacaaagagacgttcccaaaggaagggccggcctttctgactaatatatgcgtagagccaccacggtatgagggcgacatcatctatatatcaacgaccattatgaaggatgtgccactcaagcgagtaagtgaaagtgctggaaagggcggagccggctgggatgaaaacggccacgtcagccacactgagccatgggttatacgcctaggggaagcgcgccgctatacgccttttcatctcacgtcgatatatcttgattggatcttgctcttcgaacactcaaagcttccatggagcgagtgtgtgaagcagggcggtcagtgtctattgacaggaaccttgtatcttgcttgtgaatgggcctgcagatacgggaccaaaatgcgttcaacacgtgtggcgaaagttgacggatatgctactcagatactagacgcatgggtaggcgataagtcagtctcaattccagattggatgcacaaatggcgccaacgcatgcattataagtatatctcatcagtagacgttggctatccggaagttaagcgtacgggattattagaatggtcgatatctagtctgcaagatgctatcagtgtagggcttgatgggaaaacgaattccccaggtgagacacgcatgccattcgtcgaaaaagacgacggggcgtatcctcttcaagcgtcagctctaacaactgcggccccgctgcgattctggctatgcctaagtgcgtgcatcgagacgacgggctctctccatctagatgatgatgacgacgaggttccaccattccgcacatactatcagggtgttctgtcttatttaggtaagcgtcctgggatgttgggccgcaagctcggcaaggctgtggtggtcatgtataggctgctactgacagatgtgaacatgatggtccctgatcggcccatggtacgcaacgacggtagcgggcttccattcgacgcagatctaaaagtcagacgaatcttcgacaactggggattagagatcattcggaagaatcttgagatgccgtcagctagtagggatgcatgcgcgcttatgatagcgtcgaagatacccgaattaaaggaggggttgtatgcgatctttgtcaaatattccggttcggaaaaagcaatccaggacaacacgttcacaatgttcaacagtaaacttggtgacgtagtaacccatctcgcagctgctggttcaattgaggggtacagccgatcctgcttgggatcgctccctgtatcaggatataaatcacatatgcagcgcgtaaagcttgaggggattgacgcaagcgtcccccgtgaagccgacttcgatgaggagcagatattcacggcagcactcgagaacatggaagtgcctgatcaccctggtttcttcaagcacttacatgagctgtcaaacgctaagtccgcgggtgctgaccgcatacgttttggcgtatcggcccgtactcttgttccaaatctgggagtacatgcctcagatgatgtggagaatcacgtctctaacaggaaggatgtgttacattggacggccggtttcctgttgagtttggctacgatgttaattgctcctctaatatcaagcccattcccactaggactgagatcggtgccggcgcgtatcgtgcgctacatctacaaccttccccttggtcagcaggtgctcattcgcccaatgtacaaggccttggaacttttcatgcgctactctgaagatgggtattcactggcaaagagaacgggaatcccggttgcggatgtggccggtagcatcaacacctctatagactgtgttcacgaccctaacctcgtagtgctcgcgcatgatgcttcagcgcttgaccagcacatcggtccagcgcatcgtgctgtctggcgacgcgtcatgatgcactactttggtgacatagctactgatataatccgaaggctagaggaggccgcaaaggagcgccctagtaatatgagttacggtgaactggctagtcacgttttaaagacctgggataacgcgtattttaagacggaaatccccagcgcaccgggggcagtgctgaacgttgatacgcagccatctggcgcgctgactactgctgtcgataatacggtagttacaatggcgatgctgcgtatgattgagcggaaaacgggcctagcacagttaacacgtgaggtatggggtgatgactgctacgtacttcacagattaggcgctggtgcctcagccgtagacgtggccgcagaagcggaagagttggcatatattggttccggccagaagcttggtacagtagctgactcgacatccgggagaggggtgcatttcttgcaagtgtactaccttgggggacaggccatacagcgccgcgtcgcttatgaccatgagaagtcacaggccgggagtagactccccggccaagttaatgagctgctcgataaggccgtcaagctagcgagccgcggaggaaatagcacactgttgaacattcttcagattataactgtactggaagggtcgcatactacacagttcgggcgtcaggctagcacagatttcaattcaatcgccgcacctggcggtacgaccaacatggtgttaatcggatttggtcagcctaactccaggctgttcctggagctgacagactggtttcatgaggatacgactatagaacccgcggcaaagctggaccagccgaaagatatcggggatcgcttgctagctacgcatagtgattccccagtaaccgttagtgttgggggggttgagcatgtgaagagtattgacgaaggtgatccggtacgatattcgtttagcgagctaggagatatgtcatcgaaagtgctcctacgtcaggaaagacatagtcccttcaccaacgcacagaagcgcgggtcagcatacagggagttggagcagaggggtatgcttgagaaagcgtactccaatagcataatccgtacaggctctatagccttaggtgccgtgctgcgagaaaagcgtctggcgccaaaattcaaagagcacgccctagtgagtaaagggtttataccaattcggggagtgatgacagctccagaaaagaagcgagtcgcaatgtccacgcactcaggtattaggcttggcaggatgatgatccactattcgatgaatgagtccaactatgtaatgtgtctaccgaattccatgagaaacgctcctgctccgtggtcgtggaaagatgcccgtcacaacacatatgatgttatgtcacatgacgggactcccgctggtagcccatataagatcctcccccatccatacttctccatgccattagctacaggattgctgttgagttttacgggggtacatgccgggagatcagcactgcgcgtgcgggacggaatatctctattctcccctgcgagattcaggcatgatatgacaccagaagaggtaatgggcgatttaaaacgactgagtattaatgcgcatgatgcatacctccgtaacgtggtggggttctcgagcgccgagacagaaacaataaaggtgaataccaataagattagcctgtatagagatattagcacggctacagactacgcctcgcttgcagatgtccagaagtcctgcagtatcatccgggtgaaagagctgatacgactaacgagtccagaagcttataccattatggccggactggatatagatcaagctaacgtcatcattactcacgtgatatccttgctgtacgagtcaatcaacattgcgtgctcagtggtcatgccagacccatcagcgcgcagaatgattcccgtcccaagaatcacgataacaaccgctttagattgagaccgacaatgaagaatccatc

SEQ ID NO: 628 - DNA, 4227 bp, Unknown
  derived from dsRNAs of unknown virus
gaatactttaaactacataatgcagaacataattgagttacaaaatgagagagagagagggattagagatagattgcatacaataaaagacctaattgaggagacacaacagcgcgtgcgcccaggacagggacaggcaatggttgatgtcggtaactcacaattcgatatgatggttagagtaagcaaatatttcattgatgttttgaacgattatcccgaggatggcgagcgagctatgctcatgattgaagaatggtcgaagcaagatagacacgctgacaacctaaacgtaaccaaaaatgatttctttccgtgcgtgatacgatcacttaaggaaacggaattcaatgtgtctcaaccaccggctgtgctgacacagcatggtatggataagatgttacgagctggattagatgggacgaacggcgtatctaaggacgatttctcaacgtcatttattcacaatgtcaagaaaggtaacgtggcaatactagagaaaggctcttcctgtgtgattaatggtgtggagctgaaactgactccatcggaggcacgttcaactgacagtaaaccaccaattgatagtgatgtatcgtatactgaatcctgggttaatagatggggtgaggcacgtagattcacaccattcacaatgtgttccagctatgcaacgtggattgagctgtatcagcaaatggacttggagtggccagaagcgaaagcgagaggtggattcagtctacttgttggatgtctatatctagcctgtgagtgggcctgtaggaatggaactgctttaaaaggtggcgccaaatccgcagatggttttagtaaaaacatcttacaatcatgggtggatggatcatcagttaaaattccacaatggatgaacgtatggcgtatgccaatgggctacactacaacaactcttgttgatgttggatatgaagctctaaaaactagaggcttaatggaatggtcgcgaggtgagctttctaagtcaattggcggaattgtgccagctgaaacccgtatgccgttcgttgagagatcagaaggtgggttcccacttcaagattctgctttaacaacaatgggcccattacgcatgtttttgtgcttctcagtcgcgttagaagttactggatcgtcgcatcttgatgatcccagcgtaaatttccatggtttcaataactacttggaaggcgcgcttctatttcttggaaaacatccaggacaagttgggaggcaaatggacaaggtagtggtgcaaatgatgcgccttttgagcgctgacctatcaatgaatgtcccttcggggataattgtaaagcaagagtttgatgatatgccttttgacacggaagtgcagaggaatatgagaatttatgatcaatactcgatagcgatacttgcacataatcataacgtacctcctaataaacaatcagtggctgaggcaataagtgcagttatcccagagttaaccataggcctgatggaaatcttcacagagtatagcgggaacagcaatgctgcagataagtacaatgtctcaatgtataataccaagatgctggatgctataacgcatttgactcaccctggtaatatcgaaggatatagtagatcatgccatggttcgttgcccgttaagggttacaagtcaaagacgcaaagaatagtgctggaaaacataaattccagcgcgccacgattggttgataaatatgaagaggagttattctcagagatatttgaaggcttcattccaccagattcgaaaggaatgtttgataatatgtgggctctgtcaaattcacgttccggtggtgcagatagagttggctttaaagtctcaccccaagtaattctagattcagatctagctggacagtttgatgaaggttttgtgtctaatcgaaaggatgtaatgcactttactgcagcattcattatgaacgagacgtcgatgatgactagagctacgccagagagtccattccctttaggattgcgatcagtagctgcgcgcgtcttgcgttacatttataacttgccgatcacgcagcagattataatgcgccctatttataagcatataaaagatttcatggctcattcagaagaaggatacgctattgagcaaaagattggtgtagctgtggcggatatgtcaaatgaaattaatacgtcgatatcattgatacatgatccctccacggtgtgcctagcccacgacgctagcgcactagatcagcatattggatcgcgtcatcgagaaatatggcgaaaagtaatgtctgatgtactatcagaattcgagaatgattcattatcgcaaatattgaactcagatgtgaagtatcgcgagttagttgataatgtactatcttcgtgggatgacgcatattttgaattcgccgttcctcaagcgccatcacaattcctgcacgcggatacgcaaccatcgggggcaataacaactggttcagataacaccattactactatggcaatgctaaacatgattgaagctgaaactggagataagccgttggcaaaacaagtgtggggtgatgattgttactttgcaatgcaattacgatcggatgatgatataattacaaaaattaagcagcatgaggatttagctacgggtgcaggtcaggtgttaggcaccattaaagactctacaagtgggcgtgtcgtacattttcttcagaagctattcataggtggacaggttgtatcacgtaggatggcatatgatcatgaaaatgcgcagaaccacgaacgcctcccgggcttgattggtgaatacctcgacaaaagtcgcgacctcgcaatgcgtggtggtaatctagtcttactaaacatgcttcagctaatgaccgtaataaatggttcgcgttcgactgtttttggaaggcaggcggtcacatccttcgaaagcattgctgccccgggtggtacaactaacagattgctattcggctacggtcaaccaaattcaaaactataccttgaactaaactttccgagaatgtatggtgatacaaccggaatgtacgtggattctaaagctgtactagatacgcctaaagaaattggtaagcgagtaattgataagctgtcagaagaaaaggcatcagtgcgaatgcaactgggtggtatggaaataaaacgtccagatggtcaagactatacaatggatgaactacaacatactgcatctgaacgattgctaaagagcgataggcgtaggcggatgggacttaatgaaaagactcgcctcgcattaacagatgccgatgtcatggatcatgactatgaaagagcggtaatccgtggtggttacgatgccattggtggcatgctgcgagataagcggttaaactctaaattcaaagagaaagcattggttgccaatggtttcatatcacgacattctgataagcaattcacgcctgaaataaaacaaaatagtgttagccaacatattggcatccgtgttggagacgcgaccataaaatacagtttcaatagtacacatgtgatgtacttaccgactaattcagatgaaaattttgatcttatgtcattatcaggcacactagtgcaaagatataagcagtactggcatcctttctatagcttacctgaaaacataagattccttctagcgctaactggaatacatggcggtagagatagactgaaaataaagtctcacattaataaattttcaccatcacatttccgtaaagacctaatgccggagcatatcatgcacggaattgatagggtcaggaaaaagggagggaatgttagagaatacctaaaattcacaggtttcacatcaatcggggacaataacgaaatagacgaaataatgcgtcatattgacaaaatgggattgtatcgcgatctctcagatgctgatgagttctcatcggtatttgatgtcgttaaatcgtgctcaactcaacccatcttggatcttatctcaagaacctcaccaactttctatacattattatcgaccgtcgactcagaagtgagaggcgtcgtattaactcattatattggcttactatgtgacgaaataaatgtagcgtgcgtgcagcatagatcgagtgcgaatccacgtaattttatccgtataccaatagtgtcaattgaaatgtctttctaataagtatgtagtttgaatgcaacatc

SEQ ID NO: 629 - DNA, 4221 bp, Unknown
  derived from dsRNAs of unknown virus
gaatcctttacaatatatacgtaatatcaatgaatatacctagttttgtcaaaactagattatcgcatagatatgaaagtattaggaacatagtgtcacatggaaaagcgtccatacggagcaacccagactcgacattcgttgacgtgtcaaccgacggtaacgcgcagtggacaaagatgacaagcataatcgacttttttatgttgcatgtctccgacatcgaggaaacgattgaggatagcaccaccacaatgttaaaaagatggtgtgagtgcgaccgtgacgccagcaacgtgaacccaacagcatctgatttcttcccgacgctaatccgcggagtggaaaagaaaagcaatggcgtacgcgttgctgatgagtttcctgtattggagcgcccagcagtagtcactcgatccggcgccgaccttctaatgcagaattcgcgagatggacgaattggtgattatgaaatcaacgacttgaaagacgcgtttatcactaatataggccgaccggaggttaaattacaggggcagaccatcgagctgcatgggctaacgatgaatctctcccccgttgatcttcgtgcagatgcgcagctgagtccggagtaccacgttagttatacagaatcatggcaaaaacgctggtctgaagcacgtagatacacaccgttttatctaacatccaactacctaacctggctattaatacttcaagcagccgagactccatggtctgactgcttgagaaagggtgttaactgcttatatgtaggtacggtatatctggcactggaatggttggcgacgcactgtccaaacgtggaacgcgcaaacaagcacgtatcaacaacgtcgatgctgcgggcatggaagaaccaggatgaaacgttcagaataccgaactgggtgcatgtatggagagcgccaatgcaatactcatatgttaaagcgtccgacgtgggttacaaattgccctcagacgttggtatcatgcaatggtccgccggcgtacttagtaaacaagttggttctgttaacatcgaggaaacgccaatgcccttcgttgagaaggcagacatggggtacccactacaatcatcagcactaacgaccatgtcacccttgcgtttcttcctatgtttctcgctatgcatcgagacatgttgttcaaaccacctcactggatttcatgattactacgaggacgtgctcggttatctcggctgcaacccaggaagggtgggacgtaaattggcgaagacagtagtaaagttttcacgtctagtgggcagtgatgttcgcttacgcgtgccaactgtcaagctaaatgaagctgatgacgtgaccgcgccgccatatgacccgcccaccgtattagtcaggattaacgatacgctcgcacggagtgcgatcgcgcaaaatgtgctcggaaaggagaaacgcaacgcaagtaagcgtgatatactaaccggcataattagtgaaattccatcactagaacgtggcctcaccggaattttcaatgagtactgcgtgaacggagagtcaggcgatgaggaggtcccgccgaagcataccatatccaacttcaacaaggcaattctggatgtcataacgcatacagcgtccgcaggtagtgcggagggctattcgcgttcgtgcctcggttcacttccggttgctggctatacttcatacatgcaacgcctagtaatggagggtatcgattcaaacgccaaacgtgatgtggatgacttagaatatgataagtataccacagtactatcacgcatgtccgtacctaccatgtcagagttctttctcgaagccaaagaaatcgcaatagcgaaatccgcagccggcgacaaagtcaaattcgacatcaccgaaggcgaggcgctcggcacgtcagagagctcacgcaaagagaaggcggtcgcgtcacgaaaagacgtactgttcctgaattcagcgttgatgattaacaaggaatacatgatgctgagatccacctttgaacgcgcgttccttactgggttgagatcagtacccgcacgtaagctacgttacatctacatgctgccaataccacatcaattggtaatattcaggctttataacgctttcaaagagtttcagaagaacgagccaggatacgcacttgcgcaaaaagcaggcatacccgtctttgatgcccgattggagatcaattcgtccatcgagctggcacgtgacgattccttgttttgttatcctgctgatgcgagttctttggatcagcacatgggtgtcggtcaccgtgcagtcctgatccaggccatcaaggattgcggcatacttgatgagattcatggagacagcgaaatgtatcaagcctttggatatacatacaaggaagccatgctgaacgcgcttgaaaattgggacgactcatactaccgtagcccagtcccaggtgcaccagatcaattaataaaggtagactcacaaccatcaggagcgctaaccacagcagtagttaactcacacgttactgactgtatgatgctgcatgttcaacgcaaattgggcttcagattcgcacaacagcagctgtggggggatgatttctatggcgtaaccagtagaaaagaaggcgtgcacaccctagattacatccaagaaatggatgatgtatgtctggaagcaggccagaacatgggaaccgtaaaagattctacacttggcaggggtgtgcatttcctacagaagtactacttgggtggtcaggaaatacgccgtcgagttgcatacgatcacgaaagcgaggtggccaacaagacactgactggtgacatcagctcatacctcacaaaggtgaagatgatgacatcacgtggcggcaatgctgacggtctaaacatgttgcaaatgctaacgatcataaacggatctcgatccacacagttcggtaggcaagcgcgtgttgacttcgattcaatggctgccgcgggtggtttcacaaatcaaattatggtcggattctcgtcggataattcacggctattcctggaactcaactctgaactgttattcggtcaagatcaagttgaaatactgcagcgtcctcagtttgagcaaccaatagataccggtaaacgcgtgctaagtagacatcaagatacgctcgctaaagtaaacattggtggcgctacgggatatcataccattggcacgctgctcgagacttccgaagtaaagctgctggataaaacgcgtctaaccagcacactcccagcaactgttggggagttctttgatctggactatgtacgtgaaatctcatatgctggtagcgttcgcggcgcagcagcgaaagcagtaggcgagtcattacaaaccaggtccctgaagccaaaattcatcgaaaaggcattaatagcaaacggtctaattggttcatcactgcgggaaacaccggaaccgaagacaaaactatcaagcacacaccttggcttcagatatttaggaaagcgcatactatacggttactcagacaaattctatatgaaactgccatccggcatgcacgaaggtgaaaacatgttcgagttacacagcgtactcggacaagttccattatctttcaaccagaaatggcatccttactatgccatgccagaaaatttccgtctaatgtgcagcctgttcggtgtgactacagcgcggagatcagcgttcgacgtgaagtcccataccagcatgttctcaccggataaatttagaaaagatataaataaagatgccgtcatagcaatagtagagaaaaccagacacgaccagcaaacacgtcatgcaatgctaagcaatataggattcacgccatttgaaatcggcatgatggatggacaattaatcaaccttgacgcaatgaaagacgttgaaacagcctctgagtacagttcaataccagaaatcatgaaatgtttatcaacacgagaactagatataataatgtcgcatgttagtccacaattcatgcacggatacttcgcaaacgctcctgtatcattgaaaacgctagtccatacacacttcttatcgttgattgctgatgaaatgaatattgctatagccctcggtggggaccgaggcagtagcaatagatacatcaggatgccgacggtaagttttattgaatcctaatatttcgacgtatatgtaataaaacatc

SEQ ID NO: 630 - DNA, 4021 bp, Unknown
  derived from dsRNAs of unknown virus
gaaatatatttaaattaactttatggagaatgtttcagtttaaacaccgaacgctgaagtaaggcaggatatccttgcgaaaatcaataaaacagatgattagtatgacacagaacgtgactactgaactactacgagaaaagctgagagtaggtactcgacgcactcaagatatgaatctggacttatatgttgaacccgaaactgccgatctaccaatcctctcgagggttagaatggacggtaccgcacacttgcgaaaattgacggttatcgacggaaaagttgacacaacagatcatacacagaaatacatcggtttcacccgatcccgtgaacagttaggctactcaaagagtgcctggaacgctgctgacggtcggactgcaaacgaagttttggccccactaactggagcgctatacaacagaactttaataccccctgctggtagacaagcaatgaagcttaaaattggttcaagccaagtagacttcacttcaatctatgagacaccgcaactaggctatcacactggatacgctgttggtctacacaagactgctgagactatgtcgaagaaggatcttcttcagatgtggttgttcggtgaagtcgtgaaacaaggtcaatcacaagcaaagttcctgacagtggtacccaagccaacacaagacggcaacgctaacttccctaatgttttcaatctgtgcacaggtcacgcaccatggcagaatgaagacgctgaagcaaccctcgaacgcctcgctctaaccatggtacctagtacagccaccaacgcactcaaaatgcttggacctgcacttgaaacacttgctggtaaagctaaccgattccaaggcgcactacgatcaatgttcatgaagagtcaaggtgactttgttgaactagaatctgatgaagaagtgttcgcaatggcacaactgatgatactcggccgagcattagttgaagaaggattcgaagacaatctgattgtcccgtcctctatcaacatgcaggacagcgactctgtcgccatttgtgacggcacactgactggtagtgctgagaagcctctttacgacctggcaaacgcacgtctccacgtaatcgacgaaggtcacatctctatgtggtgtcttcgtgggtcaatcgcatccaaagatggatccaagaggttccgtaccttcaagccttactggctggctggacaaaccgacttgagtaaagtcaaaaggaccgcacctagcatcatttctgataaagacgcagaccgatacatggaatacttcctcactggacttgaaactctgcttgaagcagcttctctcgaaactggtatgatagttagaagcatggctgacatgcatcttgacacatacagtgagatggattctgccaaggtagaagatttcgcaaccagtgaaagaaccgacatggtcgctctcattcaggcatctgctatggggtaccgcaagctcgctgactaccacgatggtgtcgaagcagctactactgcggcaaagttaaaccacttccaggatatcatcaccgatggatccatcaacattaaccacgtggaacaacacacaatggaaatgcgcgaactagcatcacgaactatcaaaacaggtggccgtgttactgaaggagcagctctacttggtgagattcacgcggatgatgtcgtccaccgccgtactcaagacggtatggtcacgacatccacaacgatcaagctgagaggcgcacctagagctgtcaagtttacagtatctaagttcgactccgcagacccagcagacgggacggcacttacctcattggacatggtcctttggcaaagtaccccctggggctggcattgtgaagcagctggagtccgacatccaatcgatcactcgattccccacgttgcaggaactcacgacattcaagtcatgggtcacggccgtggatacggtggtttccgaattggtaaggtcgcccgttcaccagcatctggttccgatggtttcgatatttatccggaagcgttctatcgtaagtcacctcttaccagtatggtaattggggaccaacttcaaacatcacaattgtacaaactggcggatcactttgccactgcaattcctttcaagtcaaaacttgatgcatacagtcctgctaccttggacatgatgtatgagcttaagatgagaagtcctgtctcactggtgtctgacaccatcgacatgattctcaacgggcctacatactgtactaacacaggacgcctcaagctacgaactcgtctcatcgagcgacatctcactgaccctgatttccacaagaagttcgaggactttgacgatggtttcaacggcatggacagtcttctctatttgattcctaagggatgcgacgcaaacaaattcgttcaatcacttgcagcaggaaacttccttgcaatgcaacttggtacaatcgggcgtatgtacattccaaatgatgcgtcaatcttgactcttgcaccagcagctatgctgtacagcgaggaagatgacgtactttacaacttcaacagtgcaggtttgcattgggacagttatcctatctgttcttcaggtggagccgctgtcagaggtactaacgtacagacaatcttcattggaaaacaaacaatcgacgcagctattcaagaatatcacatcacaggacttggagacagtgtttctggacgcgcagccaatgggctcggagcgactcagcaattctacgacttcatggacgaggccctgtccaactcacacgctgctgcagacgtgaggaagaactggcctggtatgcgataccgctatgaagtactggctctcgctccagcagaccacatttgtgaagtgcttggcaccacagatgtaccagcaggctatgacgcaacaacaggtatgggtagtaaaataccagccgttggtggagtcgcaatgctaggatggcgcggagaagctacgcttcttacagctcaagacactctaggtgctggaaagtcactcaccaaacacaacatccgtcgtttccttgaaaagatgcgtaacgatcgtttgtggcttgaaggtggcagttcaatgatcgaattcgatcaagacgcacttgaccttgacgaaagcttgttcggcgcattgattggattcaatggtacgaacgtgatatcaccgtacatcactcaacttgctatttatggtgcaggaggagaactcgaaggcgaaatttctagccacatcgaagacatctcaatctctgtagcatccaacaagatgaagggcgacagcgcagacatgaccgaagggtcagttgacgaagcgtctagcgccacgtacggcgagtgaaaccaaacaactattcctgagggatcaatttggctaagaaaacagttaaagaagataaggaagagaaatctcaatcagtcgatactgatgagaaaacaaacccaccaacagaagcagtaatggacgaagcaaaggaagacaataaatctttcgacgctgaagaacaagctgctaaacctgaagcggaaattgctgcaccaactgtcttctcgaagacacgtgaaggcaaggacccagcacacagcggtgcgctagagtactccggtactcgaaagaacgataagggcgaagacgtagagaacactctcgaagacgcgctcgatgactttgaaaaggcaggatggaacgtcagagatgtaccatttgaccaagtagaaggcaagaatcgtatcgaaagcagaaacccaaaacgtgccaagaaccaggctgcacgaagccggaagaaggaccgtcttgccctagcgaaagctgaagtggaaaagacgtcacctgaagacggagctgctgcagagttggacaagtctgatgaagaagaagacaaggcttgaacccttaaacatctgcgagtaacatcgcaaggccaacatgatggatgaatgtccattcctgtgcgcagaggagattacctctgggaatcgagagattccggccac

SEQ ID NO: 631 - DNA, 3910 bp, Unknown
  derived from dsRNAs of unknown virus
gggtaagataccctggagaagataaatatgccaacattaagtaacaactttggagcaagcagtatagctggtacggtttcttgtacaactagtctattaacgactaagtttcaagtaacaccgaacagttcaacagtagaacatttctttccgtttacggatttggaattcagccctgcggacgcttcaaacagagaaatagctacagcacgagtaccagcagttatgcacataacagccgacggtatttcagcaaaccgaaagaaaggcgaaaacgcacctaagaacgtgggtgacggacgagaatcgtatccgttagactacgacagctttgactggcctgagagtgaagacgaccccaactacgagagcaaccgaacttcccgagcacacgaacagaaatcgtggtttggacgtggaatggttgacttcttgtggggatacgatcacctcggaagggacaagaaaggagcagatgcaaatatgtttgaacaagcgttcagcgaggaagaggcagtgaagttagtcgctgatcatccaacactgagcaagattgtgtacgtcgtaacaccacgtacagtgaagttcttttaccatgatagtttcatccgacaagtagtctcacgaatgcgtgagctcttcgagtcactcggttcggcgaccccgtccgtgtgtttcctaggattaggagatctaccaaacagtgtccaacgtgttagaagcgtagacgtacctggtagttcacgaagtagagtcggaagaggcaagagctcgttgagtccgaaggaaggattcactggcaaaggtaactacaaggtaacacgtccgtcaagactgtggggtgctggagcactcggctggaaaggcggtagataccaagctcaaggatcaatctacataccgatggattacgtaccgtattctacacttaagagatcagctcgctacaaccacatcttgaaccaactaggtctagagtggatggacagcctaaccgcaatcggttcggactggaagacagcgaaagcatctgaactaagtgacgaacaacgcgcaagcgctggtccaaaggaaaagattgctatgttaaatttgttcattgcaagcctaccatcattcggagttactgacaacccatcaccatctgacgccatgttagacgatgggactgtagccgcaaatgttagacaatacttgactatgccgttttcatctgcatacacacacttggacgtagggttacttgcgtcaatcaaggagttcacagatgacaccggtattatttcagacgacgaaaaactattcggaaagccagcaaggacggcgtttcacgatttcctgaagaaccacttcatattctcgatcggcctagcctgtcttgaagcaaagtggaagctcacaacatacccagctgtgttcatgtacgaaggtggtccaagaccagaacacgtacaacagcgaatgttgatgaatttcaggcctgaccgtgattacggaggaggttcaaacctaccttacacgctgatccctacttcgctgaaccctggtgaaaccaaggcacgagttccaaccatgatgcacttagcacgcgaaagcacaagtggaagtggaaagaacgtaaacatgtacctaggtccacgggatccagtagtcatcgataacgttaaagctagccaatactttggtgatcggtcagagaccatcatcgaggacgaattctactacgcaagtccaatcattacgagagaaggtagcacgcaaagtacttaccgtaactatcgtacgatcaacatcgttaacgttcaacgaccacctttcttcacacctggaagtactgtacttggtactctcttagggatgtgtggccatcacgggatggtacaaggaccggtttacgagcaagtgatgggattaccgtggtaccatgtcgacaagaacttaaagcgtgaggttttcgttaaccgttcgtatgatagagttctagattctagaagtgatccgctatcagctaaggcaatgcatgacaaacgtgctgctgctatgctgaacggtcaaggtcacgatgtagcaggtctacaagctagaaccggtatggccaagaaggacaatcctcaaaagaaagcgacgctaggaacggccgatgatgcacaaggctcgactgatattatccattactgaggtgctttgaatgttaatgttcaaaaacacaaggactggagcgtcagccgacgaattgattgcttacaaaactgaagacgaacagacagctcaatctaggttcaaagcagcaggctggaactttactggagatttctattgggatgagacatccaagaaatttctaatcggtaaggaaccatccggtgaagaggagccgatgcaggatgagtgagaaagttgactacactattgatgtcggaagtcatcgaacgcgtgcaatcagagctttcctcagcttcctggaccaaagaaccgatgcctctggatttgttcgaccactacatgaagagattcagccgatcgacgaagataacgacagcacccccgacaccagcagtgaagaggttagcgataaaagcgacattgacagcggacccattagtgggacaaccgaggatcaagggcaagatattgcacgaactgagcgagtacgggagattgttgatgaaggaactgccaacgggccagatagtacacaggtcgcgaccagcgaacctagcatcaggccgattgcagatgaacgagatgcaacggagagtttcgaaagcgagagcgaaccgagacaatctgttagcgtattcggtgccttccaacatatcgcaagagatactgtcagtgaaacgtgacgctgtattgagtaggataaagtttgacgcggattggatcgcgcattacatcagtgaacacaaggattcttcagttgcacctggaatcaagtggagcggtctccccgaccctcgacaagataaaggtttctggttggatttcatggatcaggttaaggccggactcgagctcgcgctcgacggcgaacaccacttcaacacacctttaaatgtaggtgctagaatgcgtgctgaccaacaagtggaaccaggtatgactgagtatgaattagatatcacaaggacgagaatcgtattgtttcagacaagtctgagtacagttttcgcatttatgcccgagaaaaagaagttctataaggacgtctttgaggcctgtttagacgtattcgacctacagtcgaacgttctattcccaccggtacacggtggagaggtctatctcgcagcagcggaaggtattcatgataacgaaccagtagacattgttttgggtgacgatttcaatcgttacaggaacggtgtacagtatgcatacgacggagcaaactgggaaacgcaggtaggtacactccttggtaaaccttttgaaggtaccaaaacctactttggcggaatgtcccacgtgccttccggtgtgttcgatactacgctggacgatacgatcgcaaccctgtgggtggctagtaagttccttgacgacaaaggtcaagttgagcttcctaacatcatggaacgtgagaaagctgatgaagatgtgaatttcatgctaggacttaggtacctagacgatccgttaaagccaagattacaaggactgaaattagctcaagacaaggcaaccgctatccaaactcttccgagaggaaggctcctcgaattagagaatggatacacggaagaccaagagttgaggtggtacttagggtaccacggtgtggacatccacggcgaaagcttgctggaaacgttcaaatcgattgatggaaacgactggctgtccggtgtgacagaccaaatcgtgactggataaccacaaccaaataactagaaataagttgccaccc

SEQ ID NO: 632 - DNA, 3656 bp, Unknown
  derived from dsRNAs of unknown virus
aaaaaaaaaaaaaaaaaaaaaaaaaaaaaaaaaaaaaaaaaaaaaattttttaaatttacgacgttattcaacaacgtgaccgtcggccttcgggtattcctaacgttgatattaaaattgcacatgacgactcagcagtcaccttctgtgtgggatgaacttctagctatcgctaaagatagtccggacatctacactaaagaagaagcacagttagccgatgcttggaatgcatcaatgcgcaagttatggatggaaactccagaactccattcgtacgaaattccgatttttgaagacttcatttgtcatattgaagaccttgaaagaggtgatcaagatgaagttgatttaagacagaaacgtcttggttttgcggtaccatcaaaactaccttcagcagcagcaggcgcagccgcagcagcgaagatgtttggtaacgacttaaacacagctactgcccaattccgcgaaatgatggatgctggtcaacagatcagagccacagctaaacaagcagcacaggctgccagagaggctattcgtatgggtaaaactactctaggcagaggtggcgtaaatacacctaccgatgacggtgatggtggtacgactacttttgcttataatggtggttctagatataatcctactgggttatcgcttgcaacagaacctgttgatgttaaattcactacaggtattgaagttactagtttccctcgctattacaaggatggtagagatgaaactggtccattaatcttgaaaacttctactcttagtcttttccataatgatgagtcaagtgaatcttatctcgatccttttattgaagatttcattaaaggaccaattattaaggacttactggtacaagtgcagtctagagctcagtacaatgttgccatcaagaatcttgttcaaacagaagagtttaagaattggcttaacagtctcgcctttgctatgtctgtttatcaattctggcagaacgtgatcagttatcaagcagttactactaatagaaataaaggtatggaagcgctttatgattcacttgatccttctgactttcttaagctaggtatactaggtaagaatcttgagcgtatgatgatcccacctacgcttaacgaattcatacatgcaatgtatgcgccttataaacagtcgcacttgcctgggtcaccgttaatggtatatattccgtggttctttaaaacagttccaaatttaccgttcttagaactagctggtaataacagtgatgccactgttgttgatattgctattcgcatgatcgatacggataaaatgaacgagtggaatgctctgttctcaaaaacgaatgacacctgggttaaacctaatctgagaggttacactggcgctccacttgtggatcctggacgtactactctctttacgaattcagcttatattggttccactgtatctaatggtcaatctgttcagcattggtttccctatactgcatcagatgcaaatgagtttgctttcaattatcacactgatgctcctgatggttatcttgaagcattaactatagttgatgatgtatcaaaagatggtaagaacaagtatggtcctggtctatggggtcctttaacttatttatattctggatcgtctactactcctaacaatttgcttagaacttggtcgcaatacactcaccagggtgcgacttgtcgttctacttgtttcatctatttaggtgaaggttctagtagcgttggaaacgctggcttctatccaatcgaatggagcaatagaactcaggctttatctggtaacacgtttggttgtatccttgctggttcagctacacgctatgctcagaaatttgggactacaccgtctgttaatgcaactaagactggttttagatactctacacaacaatttcttgagtggttattctttaaagatttcgctaatagcggctcttctaaaactaatagacctctagggagatctagtggtggtaagaatcgtggcaaacgatcttataaagggtctagcaaaagcaaagattctcctgaagaaaaaggggaactttaaagtataatattgtataaggacaaccaagtaatgcgtacctattctttctcaaaagatgagcttcctgatgaatggttcaaggactctaatgcaaagaacaagctatccgttgtggttaatcgcgaattttatggtagtgacaaggttttaattacacctgtagctgaacgggttggacctgaaacactaaagtcggaatggcttaagatcctcgaggctaatgattcaatgattaatgagcctttatacaacatggaaatggcaaatttggacaaatttggacctagaagtattgcacttccgttcaatgatgtcagatctagcgtaattagttcttttctcattgaagagcaaattatgccagatctccgctttcctaaatcgcagttgcttaatagtcttaggccattaagtttagacatggcttcgaaactcgtaaagaaatcgacgaacgctggtctgaatactttacagagaaaaggatctgttcttgactatacacttgagaacatcgataccctgtatgggcttgatctacccatggtgccctttatacgtacacaagagatgaagaaaactagactcgtctttggatttccccttgctgatatcctagaagagattagatatttcactccattattcggtgtatataggaagcttccttgtttttctgcgatgaatagtcctgaggatgtcgacatttctatcagtcgtatgatatccgatgccacaagactagataaacagtgtattagtggcgacattgctagcttcgactctactgcaggccaagatcttcaccgttatgcattcaatcaatttgctggactcttccaatccaagtttagagatggtgtgtataactgtcaaagcagattctccaacaaaagtgttatcattcctggagaaacagaaggtgaattcaatcttattgaaggctcgcacggtatcccttctggaagtcaatttactaaccttacaggtagtactatcaatagaggaatttgtgcatgtcccgatgaattttctgaattcttaggtgacgatttcgctgttgttcatgacaatccagaatcgttattttcacgctacagttcatatggcatggaacttaacaaggataaaactgaagtggcagaaggttattttatttaccttcaaaaactctttcatccagattatgttgaaggaggtttaattcgtggtgtatatccaactattagagccttaaatagattatgctaccccgaaaaatggtcagattttaacgattacgaaatagacggtagtaactatttcgctttacgcagtcttagcatattggagaactgcagataccatccgttatttgagaaatttgtccgattctggttaaaatatgaacgtaaccttatccctgatgatagaagtattgctcagtatgttaagatgcgcaatgctactactggatctctggggactcagaaccaactaggtgacgattaccgcggcattaagcagtggaaatcataccaattggcgctgaaaggctaagagagccagctctggtatctaccagagcccc

SEQ ID NO: 633 - DNA, 3726 bp, Unknown
  derived from dsRNAs of unknown virus
gaatcattacgtattacaagatgtcagaagcaaaagcaaaaccattacagttgaaacctgtaccaggatccaagcaaacgccagagcaatttgaaaccgaagaactgtcgaaagaacagtacaaaggaataaagttgtcggatatacttgatgaatcaaaagatgaatggaatagcgaggataagactgtcacagtcgataccaaagctgtccgtgaatcggaggagttcaagtccatgatggaaaaaggtgaagaaggagatggaaatggaaaagccgaacccaaagacgctacaaccgaacaaggctctgccacaacagaggaaaaggaaaaagacgctgtgaagccaattgatgtaaatttggaagttgacaaagaggaaacaattgaagctgtgaaactggaggagcaaccagctacactcactgagagtggagtctcgctgccaaacgttgattacaacttctcaactacgtcagtgacgaatagcgttgatgtgacgttaagtgggccattcctaatggtgaacaaagcgccaaacgccgatctcatcaacggtagcccaagaccagatgagcaattcaaacagaaatattttgaatattacagtttcatgcagcaatggcgcaggcctaacacgatacaaccactcaagcgtaccgagagtgattataacgcgttggatctgcataacgtgtcgcacatgatgtcaactgcacaaaagttggctattgatgagctagaagttgcaaccacgagaatcaatggaatggcgacactagcaatcgctcaaacgcctaggaatatcgtggatccgattggtcagaccaatcacatgataattgatgcatacaacggatcagcgctaaatccaaaaacctatagagatgagcaattcaacacagccaaaggtgctaacaaacaccaaaaggcaatgcacgaaaatttggcgaaccgtcgattgacactaggctttggacttgaatcccgacttatgggattgagcagcgcgggacatgaggtgtatacgcacacattgtttgcagacccatatcgtgtgggtcttatgattggtaatcttacatgctacgaatacttctttctatccccaagacaattctttgcgctgccagtgttatcaccaacattgatcggtatgcttcacccaagagtaggctcaacagaaaaggataccgtttcggataacgagcttgaactattgaagtaccctcgtttcatgtttgacgaagatccgttatgtggatactactacggtacatcagcgcatgtcgacatgaaaaccgataagtatatgagatcattctacaacttttcattgacggcggcaggatctgcattcgcttcgataacagcgggacaaatgataatgccagcactacgcgccacagtcaataaggtaagcgacgaggtgccagctctgctctactcaatcgcttcttcatcagcgaagggatacgcgcaagagctaggtagattccttgttggcggttttggacgtagactgcaaatcgattttcacgcaccagaagcagacaaggcggctctactgcgcccattgtcatgtatggcacatctatgtctccttgatctgaaattggtagacatggcatgtaaagttggtttaatctccggtatccttgaaccatttgttgcaaatgagtcgcaagtacagatgggcgccgcgcaaccacctgcaggtgtggggagagcatccattgcatttgcgattgtgaatggaaacgccaacaccatcgccgcaattgaacagctgatcaggcagaatttgagacccgacatgtccaaccgtggcggccaacgaaactttggacaaccacgagctgtatcgcaaatgctagcgcgcatcgtcttccaaattctgtcgccacaaacggcggtcacttacacaagacagctcggcgcgccagcactctacaatttcgatattcgaggtaatttagcaccatatgcaccacaagcactagcaccactgcagaatttgcgcgacatattcctatttggaactcaagatatcaacgttgagatgtataaaactgaagcggcaaaccagcgtgcgccactcgtggcatacctcgcactattgaatcgcaagaactccgtaggtgacatacagacggtaaccgaggcactacttaacgacggactcgcccacgcacgttccaatttgatattctcgaagcttgtcatcaagggctctgaaaacgcagaatgcatcccatggcgacagcgagcagcaccatatggcaacgaactggacaccattaagcttccattcaccggcgcattggcttacatgttgtacggaatcgacaccgccgtacccatcgtcgacatgatggacgggcaatccatctacacgcgtatatccgatacgccatacccatcgttgttccccgcctatctattcttcgaacgtgcagccgccacgacagtgtatacccatttcactaacgtcggtcgacgcatcaattataattacgttggtattaaacagcatgacttggtagatctaacgctacgtctaatccgtatttattacaagaaggaggccacagacgccgaagagcgaatcaccgaaatgttcaagtttccaacgatcttttttcgaccagccgacatcgtcaactttgtactacctgcagcgctcaagagaccaaacgcatgggtcaccgacaggcacaggaaaaccttaatccacgccaagcgtccatatggaaacatgccaatgaaactgtctgaagatgttgcagaccacggggtattgcatatcccagttggaaacatagacataactgactatcaacgtggcgcaaacaacacggccaacaacttggaattgtacccatcgattaactactttgaagaagcgcacaaaatagactctgagctattgtcgacggtcttcatcaaggtgacatcaccaatagatccaattagattctacgatgtgaaccgaaaaggacacatcgtatatatggcgtatgatgaagcgcgtgagggtatcaccgtgcagaatagtatcatgattgaagatctgttacaggccgtgacaacattaaatacacatgatacaaccttcagcaccgaatctcttcaaaatattgcgaaaatgtacaacagacaacaaaatcagcaaaaggaatacattatcataaataaggcgcgtataacctataagctaattgaggatacaagcatgcgtaacgaacttgtgaagccactagacatttccgttgagttaaaagacactcaagctgaacgcatatataatgttacggaagtgccaatatactataaaaccatcataaatgaaaacgcactcgaacaggagctaacactcgccatgggtggtatggatggtttggtatcctcacgtaactatggccttagtgtgtatgttggtgtgttctacaaagaattcaaagcaaaagtagccaatctagacggtagacgcatggatagtaggcacgcattcaattttgagtacaacggcgaaccagtggcaaagagcttcattccaggtaacagagtgacaactaataatgggcttacattaagtgtgcctttgcagatagcaacccgtgtgcaggaagaattcaaaaccacgacaaagttagaattcaggtcctaggcaagcatcacgaaaaacaatcatgtaacatagcgaaacaacgtaagaaaacatc

SEQ ID NO: 634 - DNA, 3668 bp, Unknown
  derived from dsRNAs of unknown virus
gtaataaatgtattctccgaataccccgattaaagaggaattacctcttcgagcaagagcctcctaatcatgtttaatttaaacaaatacagtgatgacgactactccagagtcgaaggacttcgtactatcagacgagggacttagaaacgccacaagaacaaggattttgatcgctaaaattatcgaacactattatggtgaagactatgcgattgactttctagacgaaactactgatgaaagcttagtaaaggattttcctgagctatctaaacctgatcctgatccaaaagttgtttcagacatgcttggtcttgttctgccaactactcccagaccgggaactggttttagcccaaacaacaatccgtattttactcctgtgaaagagattcctaacagaatcgctgacattcaagaatttatggccgaagcccaatcaagagggaaaagtttagttgatgctggtcaagcaattactgccgctttagctgcagctatggctattggtcagaaatcatcaaatatcttcaactcaggcaaaggtaaagactccgggtctggtggtccaactaacaacgacttcggtaagttgtatgaacgactagaccctggctctacgggtaacttcattaattttgaaccagataaactctcttttgattggaatcttggtttagatacaacaatgaatggtcaagctccgttttggacaccgacaagatactcatcttgtttcgttggtgcaattcgtcagcttggaattccttcaaacgatattgaatcagcgaagaactttcaggacacacttgttccttatcttagaaacaagatcaactcagataaacgctataatgcccagttagccgagttcttcacttgggaaaactatcaggactatatgaataggtttattaaggcttgttcagtgtaccatttctttgccaacatatacgattacacgaatatggatatcagagttaataataacgctggtatacgttatatgcgtgataatcttgtacaaacagcacagttacaacgtctagcgagtctaaagcaattattagattcgatgccgtttccgcaaactctccagaactcaattgcgcaatactacggctggtactcaacttccgagtctccaatggctcagatttactgtaacgtccctgaagtgtttaaaaccactggtacagttgctgctccatcagagtcgacttacctcgattcttttatcacggacatcattgaaactcagatttctcaacttaactattatgataaggaggtcgatcttcgaaagccttattataagttaatgtctattttaaataacgtaattcctggttacgctctttcaaacatagggtcatcttacataactgatgtttacgatgagaaccacatgacaatgtggcttaatggaccgacaattattagaatggtatctggtgccccaagcactggttttggaactaaggatttaatgcatccgtatttacacaatgcacttgaccaagtttctaatgtgagctattttagtaaaaccaatgaaccgcacggctatttagaaggttatcattctactgtctctggaaatcctattgttcatatcacaaatggatatcaaactcctattggtttaacaactattgacaactttgctaatgatcacactactgtaacttctaatatatttgcttttgttgacagaaacacctctactcttagagctgctggtcctacatttgcaagtagagggatggttcttcttccatcacaaggtgaagggaattacttatctgcgactccacttccaattttatacggtcaagacgtatctactcttggaagcgtaaaagtaactttcgacgtctaccgacctagtgattgtgtggaaatcacaaatgctaatttacaacaatttgttttcaaccgaaacgcagttcttcagaagtggattgatattcaggactactcaggtggcttaagcaacagtagttcaggtggaaaacgatctaaatttagtaaaggaagatcaaaggataaagctgaagataaaacagaaactacttcttaaaacttaaactaccgataaatgaaattgcagcccttaagtgaattgtattctaaactcgatcagaaggcaagaattaagctctccaacgtcatgagacttactttggaaggtagcgataaagttctgatgtccccaccggccgagaggattggcgaacaaaacgttcagagtaaatggatagagttttactcttcattagataagtccggttggcccgatgctttaattgatatggaagatagacagattgaaaagattggacctcgttcattacagaaaccatggtccgaacgaaaagaatctacatttctaacatttcaaccatcagtatcaaacgcatcatgcgagatgacccgtagtccgtttaagtcggttaacttccgtaaattgagaccagcgtcacaagccacaagtctgaaatttatcaagaaaagtacttcatcaggagctccattcatggaaaagaaaggagaagttctagataagagtgtaaatcaaatgagtctccagaatcttggctgggcagctgtattgtatacacgaacacaagagcaaagaaagacaagagatgtctggggtatgtcgttgttcaatgttatatttgaaacaccgtttttccttcctctgcttaacttcttgagatcgatgacatggctttcagcactattagggccagaggctgtaaacgattcgatggacagaatcatccgttatgctttagctaacgacctcgtaattgtttcgatagattttacatccttcgacgccaacaccagaggtaagatacaagactgtacctgggaagagatccgaatgttatttcaagacacgtcagatgttcaagatgatcttggattaatagaggagattttcagaacggtaggtcttatcacaccagacggtgtaatagaaggagagcatggaacaccttccggttcaatgttcactactccagtcggttcgatagctcatgctattgtagtctcaagttccggagtcgtagagttagacaatagtcagattcttatcgacgacggtgtacatctaattaaaagggagaatctggagagattctttgatgaaattgagaagtggggatttgttgttaatagagaaaagtcttacgttgaagacaccttttctatttatcttcaacacttattccatcccgatctaactgtagatggtaagattaaaggtgtgtatccaatctcacgcgcttgggagaggtactgctttatggagaatttcgattcattcgccgcagataacatagtcggaggtgattacttcgctattagggcactgtcgattgtagaaaatgccaaatatcatcctgcgttcgaagagttttgtttatttttacttaaacaagaaaatggctcactggtaccgacagaagatgggatcacaaagtatattgacagacttgtgagaacagagggttctgaagggatactctttaacaaacacggtgatgaccctagaggcatacgtggatggagatcttataatttctttaagaacttagaagagaagggtagagcgtaaaacccggagtcatatcattgatatgactctc

SEQ ID NO: 635 - DNA, 3644 bp, Unknown
  derived from dsRNAs of unknown virus
tggaaaaatacccagttcgtttgcatgatgcaaattggtaaaacccgtcacagtcctgacgtaaacactggttcaacccgccgtaagggagagtgggcggagcatttcaactccgcatctttgtacgaaaactacacacaattcgagtctaatatcaacttcgctcgtgagcagctactcgcgattggatgttggcagcagattgaacgtgagagagcaaaaacatacccgaaagacctggtccctgaaactgcctcacaggagcttaagaggcaccatgaatcgtttgttatttcgtacattgccctcctcaagaagagtgagacgattactgagacaatcagtcgagtatccgaaaggatgcagggctcgatctcaggaatcaaagacgtctcatttccgacagaagaggagatcacgacagcaggagacatacctgtatcggtgatcgacctaaaggatactaccatccttgggacccacccacgcgccactaagaagtgggcacgccgagagctcaaagagtttcaggcaagcccaactccctggcagcttggagaagtcatttcccataaagagtggaacaagctgatgcatatcatgcatggcaacacaacacccgtccctggtgggccactactgaagtcagtggcaaaggtgatacccttgaaagaggcggctccggtgcggctcccacaggatgatcttcccgaagctgaggaagacaatgcggatgacggaaccatggaatcaatccgtaaggagatgatcaagaagctgaggagtggcgtggtcaggccatttcgtttgcaacctgtggtgaacaaggatacaggcgtaacctcctataaggcaccgaatacgcaggagtgcttgcgtcagtggagtgtctttcaggagatgtggtcggagtggtggattgctgcccaggtaatcactggcgaatacgtgagcccattcgacctttttccaagtagcttcactttcgcaaagcgagtggtgactcctgactatacgaacttactgtggcaaaacttcgtccctatgttggcagtcaagtcagacgatgatgactcatcactcgggtacaatgcaaataagggcattgacttgtacagtcaaggcattcattggatatttaaatcagagcttgagctcgtgatcgttctgctatcgatcttgctctccaaacctatcttactcacgcagaaggaggttctcgcgatggctactcagacgccgtcgatgatgaaggaggcaaagagtgtaatatctcagattaaaatgttcctctcaaagatcctgaatgcaaggactgctctgcgtgacccgagctatggtgcggtgaagaaggccttcagagaccgaaggatgttgcttgacgggcagatgaaggccgtccgtgctcagctcaaaaagatggagaaggacatgtttcgtctgtcagttgatgaggacgaggaactggccaagctggacaggaataggaagcgtaccaaagtgtcaatggaggagcgactactttccatgggtctcaatggccttcctgtcgcagcagaggaccttcagaaaggtggcacacaaaacgtacctgagctagacgcagacgaatgtgatgaagaaggttcagatgcgcgtgccctccgccagttgatgggggaatagggtttttgctccgggttggaaatgggtagggtggatgaggctggggacagtgtaagtgttgtgtctagtttaatgagtgtgactgactcctcggcctctggtgtacgtaattacgattgggttgtaaagtatagggaatttaagggagtgcgctccgtgaaatcattaccacttcttgggtttcacggggcgtgcaaatacagttacatggagccgacgactattccttcgtctctgttccagtctttctacgctaaagcagagacttgcgcacttttatgggaggaatcccctgagggtatttggacaaaagaattccgtccacctagtgtcagcgatcttgcgatgcatttagagcgctttggtggggcgcgtgatttcaacactagtttcttcgacgcaaatgtgcgggaaactatgactaggatgtcccggattgagggggacctcccgacagtcctggttgacacgtggctcaccactgataatcttcttcgcgtccgggttccctcgaacacgtcagctggaattcgatggaaaaagaaacaattgcgagctaaagttgacgcactgccgtacgcattagaagaggctgtcagggacatagttgggttgaaagaaggcaggccttatagcacacccccgtgcttttgtgccgctaggggtaagatagtagacatttttaaggggccggggaaaaaggaaggcagactcgtcttagttccagacctgaaaaggcatttgatgggttcgctcacatctgtaccatactcaaaattagtctcctccttctcaaagaagggtggaggtgtcctaataggaatgggaaattaccacatgaattactcccaactggctgaggacattgcaggaattaagaagcctgtagcttacttgtgcgtggacttttctggatacgaccagactgtaccagctgaagtcattcaatggggtctcactagaatctcatctcgtttcaaaacttgccaggggagccatgcctactggaaatccgaactcaatcacctagtgcacactgaaattgcctttccaactggagaggtttacatgaagggcaggggtgttgcgagcggggatccatggacatctcagcttggcagtgaggcgaattggctaatgcaggaacttgcttttaggttccttgggtggaatgcgcgtgcatggacatttggggatgatgtaattgttgcaatagattgtcttccggaggggcgtccctctagtgcaacattattgacccagtatgcaacggcgatgggtaagttgtttggtttggaagttaagggttcagattcttactgtacacctcagctaagtatttcgggtcccgagccggttgaagggaagtctgtgaaattcttatctaatttcttcatggaggttggggtcatcgtacccgctccggagtttgcaaagactcttgagtcaatgatgtaccccgagtataatccctttacaaatgaacacactgaactgaagagttgggaagtggaagaattgctgagctttgagctcatgcgcacttcgtgcctgtatatcacgagctattggaatgaaagctcaaggcacctactagagcaataccacatctggttgctcaaccttcatgttcgcccaacccccattccaacctttaggctcatgcagcaactaactctctgggaccttgactggactactttcaacagtatctggttgacacacttacccagctatgctgatatcctgaaactgtacacttcaattccgcaacatgatagggtagacgtcggattggctagagctaagcttagcaggcttaccactttccagtcccggagcacatgagtttggggggagctacttcccctcgcgtccaacggccataaagacgataaaagtttggtcttgacgggaccaacgtaacaggatgagtgatagcagtagctcgtcaactggaacgttggagccccccgccc

SEQ ID NO: 636 - DNA, 3643 bp, Unknown
  derived from dsRNAs of unknown virus
ggaataaaagcattcaaactttccgactaattattcacctcatctcagtaggtcggacatggaatctactttcatggtattcactgggtgatacaagacaggagacaagtatgtctgaacaagacggaaagttgctctggtcagaaagacttctcgatctcattggggagtatgatgaccaaaccttcgtagaattagaaaacgcttggaacgcagctgttgaccaagaattcggcgaagactcttcactttatattaagtgtagaaaacccgaacttatcgatttcattgagcatatcaatgctctcgaagctaacgacaagtcacctcacaattttggggctagcttcgtgaaacccggtagtgcggctggaatggcggcaggtatgaaagccaccttccaaaatttcgctccaggaatggataaatcattccgaaactttgaagaatttatgcagttcggtcagaacgcttattcaacagcgaaagatatgagagcgaaagctcgtgcctttgttaaccgctccagaaataagatggcagcaggcggtaatgtgggtacggatgatggtgatggaggtatttcttctactggttttactggtggtaatcttctaaatccattcggtatcagtctagccactccaccaattgatgtgaagctagaaactggttcatcgttgaatgcctacactcgtttctacaaggatggcagagataatactagtcctatattcgttaaagtttgtaaccttaacttatttcatggatcaagtaattctgatttattttcagattcgtacattcaagattatctagataatgttgtggttgcggatttgctacaaaatgtacagtctcgtgctgtatataataaatatatagcagaattagtaatacctgaaaatttcaagagatatattaatactatcgctttttccttagcggtatgttgtttttggcagaatgttgtttcttataaagaagtcagcagtaatagaaataagggaatggatgctctttacgaaacgttagatccttctgactttctaaagatgaacatattaaagcagagtcttcagaagatgatgattcctccaactttatatgaattcattcacgcgatcttcgcaccctataaacaaaaccatcttccgggcagtcctctgatgatttattcaccatggccgcttgaaacagttactaatttaccatttactgaaatgagtggtaatggaactaacaatactatggtaaacatcgctatcgatcgtttaaataacgagtttatctatagatggaatgctctaatggccaaaacaaacccaacgtggtctcaacctactatccgtgggtatactggtgatcctcttgtagatcctggtcacactacactttgggttaactcagcctatatttgctctactacgtctaatggtgcaaatgtcaaacatttcttaccaattattggtgccgaaactgatgaattaggctataatctacatactgatgctcccgatggctacctcgaagcattacagcaagtagatgtaacatcacagcaaactaatagtaaatacggccctggaatacaaggtccacaatactatagttatactgacgacttagcgaacccaagcgttactacgctggaatcaggatacacacttaatggtatagaacactctacgtcatgttatgtgtatctagatcttgattctattggtgtttccaatcccggatactaccccgtggaatggtctgtgcagacgcaaagtctatcaggtaatacttaccaatgtcacgtacagggcaatggtacgatacattacttccaaagatttggaactgaaacagtgtgtaactacacaaaaatgggttctagatttagtttagaaaagttccttcagtggctcttctttaaagatttcgcaaacggtgggaatcaatcgagtagctacgatgctcctaaggggaaaccgaaatttaagcctaagcctcgctctaggcctagaccgcgaatgaaaaagtcaaaagatacagataaaactgatactaagactgagctgtagatacgtgtagttgattataatagcaacaagtaataatgcagacctttgatttcacaaaagatgatcttccagatgagtggacatttgatgatgcgtctagaaacaagctttccaacctgatcgagaacgtgaggataggaagtgatcaagttttaatcaccccagttgctgagagggtaggacctgatgacttattgagtgaatgggtgaaaatcctgcagcgaaatgaatccgtcttgaatttgccgttatatgatatggagatgggtcaattagataagtttggaccgaggtctattgcgcagccttttgataatatcaggtccactgtcatgggtacttttgaaataggaaatcaaattgtgcctgatttaccctttccaaagtcggagtttagaggtaaacttagacctcttagttatgaaacagttacgcgatatttaaagaaggcaactaatgctgggttacctacattaaataaaaagggaaaggctctaaattacacattagagtatcttgaatttctctacagccttgatcttcctgtagtaccctttatacgtacgcaagaaaacctgaagactagattagtttacggatatcctctgtctgatatcataaaagaattgaaatacttcaaacctctcttcgacgtttaccgtacaataccctgttttgcagctatggttggaccagaagaagtagataaagctatgacacgtattatctacgatgccgttcgtcttaaccttaagtgtgtttccggagatattaagaattttgatgttaccgtaggcccagatctacacagttatgcttttaaccaatattcatcattgtatcaaacacagtatcgtgatgagctttcagaaattggttatcgtttttctaacaagggattaatcattccaagtgaaaagaacaatgctatagagtatgttgaagggggccatggtatattttcaggaagtcagtttactaacttaaccggtagtgttgttaatcgagggatttgcgattgtccaccagaactgtctcagttcttaggcgatgaccttggtgcagctgttgccgaacctgaagagttatttgataagtatgagagatcaaacttaacacttaatcgagataaaaccttaattgcagaaggttacttcatataccttcaaaagctattccatcccgattattatgtgaatggtttaatcagaggaatctatcctactattcgagccttgaatagactatgtttccctgaaaagtggagcgattttaacgactatgaaatagacggtagtaactatttcgcgatgcgcagtcttagcatattggaaaactgcaggtatcacccgttatttgaagaatttgtcaaattttggttacgtcatgaacgtaatcttatccctaatgaatatagcattaagcagtatgttaagatgcaaaatgctactactggatccgtggggacgaagaaccaatatggtgacgatcttaaaggaattcaatcctggagatcataccaaattgctctcaaaggctaacggagccatccttggtgattaccaaggacc

SEQ ID NO: 637 - DNA, 3621 bp, Unknown
  derived from dsRNAs of unknown virus
ggaaaaattattttctttaagagggactatccacgaactcccccctccccttcggggtttctccgtgagttcatttaaatttcagataacatggttgacaatagcaagcaacctactgatcagaatgaaattgatactaatgaattaatgacggcattcggtaaaatgcttgaatcgttaggtttatcaattgacagttctgagacagaggctatatgggatacattagtaaacaaagtatgggctgaagacccagaagctgctgatgtaagcaaacccacttacagtgatctgatcgatcaactagccggcatacaatcgccacacccttcacttggtttggttccaggcataataccgttacgcccgagaagaccagccatcagtccgctgactcgaccaggcactccgtcttggaagatacccagtttagatgaagttgagcaaggccttagtgctgctcaagagatgtacaatgacattaatgctaaagcgaaacaagctgaacgcattaaaacacgcatcacagaatctattaacaagtattcacgaggaggattcaaaggtgatgatggtggtgatggtggtacaaccacatttgattattcaggtggttcccgctacaatcctaacggtttatcgctcgctgctgagccggtagacgttaaactagacactggagtaggtgtcactaacttcccgaaattctacaaagatggtaaagacgagacagcacctgtggtcattaagtcaatgcaactgctgatcccagatgatgctgacgctagtcacgtagattcggaaattagagattttcttgaaggtccaatacttaaaagtttattggccgagatcatttcaagagcgcgatttaacaacaatattaaaagtacagtgacataccagaagttcgtggcactatttaatacgttatctttcgcccttagtgctcagtgtttcatggacaatattattgcgtatcaaaataatattgacaataggaatcgaggaatggaagccttatacaatggtttacaaccctctgatttcctagaacttcaaacgttaagacaggagttacagaagtgtctaatccctccaactctttacgagtttattcatgggctttacgctccatacaaacagagccacatgccaggctcggcactgatgttactcatgccttggcgttttaaagaagctgataatcttccatttacagagttatacatggcagacacgacaaaatctctaattcaagaagctcgtcaagcacttagacgtgaatttattcttgattggaatggactgtttgctcaaactaatgatacatggatgaatcctcgggttagaggctataatggtgaaccttatgttgatccaggttttacaactatgtttgttaacctacagtacaaaggtactagacaaggttctggtggttctatcgttcaatcgttagttcctaatatagctggacaaactgcacagtggaagtataactttcatactgatgctcctgatggatggactcaactccttcagactgttgatgatacatcactgaattccggacagaataaaatcggaccaggtttaggcagaataggtatgtaccgttacaacgaagacggatcacacttaaatactctagaactagtttcaacttacggcactaatggtgctaagttaacttcttgttttgcgtatttaaataaaggttctgctggtgttacaactccagggttttatcctgttgaatatgcgacgcgtgttcaaactttaacaggcaatacttacactatactggatcaagttgctgctccacattctttccagcgttttggcactacgccagctgaaaataatactaaaactggacttagatatactatcaaacaaatgcttgaatggctgttatataaagattttgccaatggaggtgttggaagtaggggtccaatgtctagtaaaccgtctaatgaacgaggcagatctagagcatctagaagaccgaaaggtaaagctagaactaagaccgcagacaaggatgaagtataactattaaaagttgttaactaaatatgcaaatcgaaaactatagattcgacgatttaccagatcattggttaaaagaggacaatctaaagtccaagctttccatgatagttgctagtgtacgtaatgggagtaacacagttttaatcacacccgtcgctaaacgagtgggacctgatacgttattcagtgaatgggaaaaggtctttttcgctaacgaacacatgcttaatgatgaacttttagaaatggaacaaaaccagattcctaaatttggtccacgcagcatacaaaagccgtggagtgatatcaaagaaacaacttattcttcgtactcgacgatagaacaatttgttgatatggttcgctttccatacagccaagccttaggtagtcttagacctaagagcctagtcgtagcgtcttccagtgttaagaaatcaacaagtgctggtttaaacacactagagaagaaaggtgaagcattggattatacattagaaaatttcgactacctgtacgatctaaatctaccaatgataccttttatacgtacgcaagagcaaggaaagacacgattagttaaaggtgaaccgttatctgacatcctgatgcaaatccgatattttcttcctctatttgatacgtatcgcaaacttccatgttatgcggccatgacaagtccagaagcagttgacgcagcaataacacgcatgctaactgaagccgttagacttgacaattattgtatatccggcgatatttctaattttgatgactctgtacagccaatgttacaaggttttgcttttaatcagatgaaaagtcttctccaatctgatcatcataatgaatttgacgtaatacaagaaagattctctactaaacctctcatcgtaccatctaatgatgataaaagtttagacttattagtaggtccttctggtattccttcaggtaatcaattcaccaaccttgtaggtagtatagttaatcagagcgtctgtgattgtccattagaattatctcagttcttaggtgacgatttcgctgttgtaaatagcaatgtagacgaagtgttcaatcgatatgaatcagctaaacttgatttgaatagtgacaagacacttgttagaaaaggtagctttgtctatctacagaaacttttccatccagattatgtggaaggtggtttaatccgtggtgtatatccaacgtttagagcccttaatcgtttatgctacccggagagatggtctaacttcaacgatttcgatttagccggtagtgactatttcgcaattcgcagtcttagcatattggaaaactgcaggtatcacccgttgttcgagaagttagttaagttttggttgaaatacgaacgaaaacttgttcctgataatgtaagcatccgtcagtatgttaagatgatggaggctactactggatctgtgggaacatacaatcaacttggagatgatttcaaaggtattagatcttggaaatcttatcaaattgcattgaagggttaacagagccagcctaggtgatatacctaggccc

SEQ ID NO: 638 - DNA, 3631 bp, Unknown
  derived from dsRNAs of unknown virus
gaatattatttgtatgtgaaaaatgtcagataagaaagatgagactaaaccaaaagcggcccaacctttagtacaagaaaatcagattgaagaccttaacaagtatgtggaggaagaattaggtaaagtggatgtatacggagagaatatgactatcgagaaaattctatccgatgcattctatgaacctacttacacatcagcgaatttcattgccatgatgaagtttgcaggtagagaagatgaacttccaaaaagtaaagaatctgacgaaagtaagaaagaggaagttggaagtggcaaggacaattctgttccatcaggcaaggagaaggaagacaagcaacctgaagttcaaaatattgataatgcattagaagtagctgttgaacatactgcggaaatactaacaggtgaaggtcaaactgaaccgacaaagagtacaacggatgttatagcagttgcagatgaagctagtcaaaaccaatcggtgaaaatattaccagcactaggtagaggtggtttttcattagaaacaattggtcatttgaactttcttaaaggtggcggagactatgttgaatttgaccatagaaaagattcattacttgaaaggaatgctttctatgtgttaaacagttttgtacctgcaagaaaaccaacaactgaagatctcgaaaatactgaatatgttccagtaagtgcgcatgatttaatttatcaaccattggctggtcagcttggctcgttatcgttattacctactaagtattacgctgttggtaatcaggataacccaagaagacaggcttttcatagtgatcttggtggtaataaagttcttatgcaaacgtatgagcgtccagctgatgaaacacgaatgccaattcaagatagatatgtgtatccggagaatgccagaaagaatgagctaagctttaaagtttttaagtatctccatccatcacaggaagacttggagtatgaatttggtgatgatttaaacaaaacatacatgggagtacttcgtgaagatagattggatcaacagcgttcgaacagaatatatgaaactactagatataatagagtagcgtttcaacgtccgagtgaagagcgtgcaatcacagctgtctttttgcaaatgccaccaaatccaattagtcaatatatttataaaacttcacgaaacgcaggcgcaagacacttaatgattgcaaatgttgaaaggcaacttgatatgccatcacgcatggatgggcgactaattcaaggattttcacttgtaaatccaactgcggcagcaacatttgctaaagattatgttttatatcttacatcctcggctggtggtgagcttcgtcctaaacttgaccaggttaatcagccagatgtttcaaaagaaacaaatgcattagctgcactagcatatttgtgcgtaattgatcataacttaatcgaaccagttgatatggcgcatctactcatttcgctactagcaccgttctatgatttaatggacgcacaaattgatgatcaagtggtggaaggtctaataacaatagcaaacaagcttactgcaaatccacaagatacacgtttacctgcaatcattaaaacaatcattacaagaaaatatgatcgtgcggataacaggaatgtaaagacaaagcttgaagcaattatgcgacaggtatttacgttgagaggattgcagcttagacgtgttggcgttgatggacccattcgtggatataaagatgacacctattccccattcttaccaaacttacaagatggtcaaaccatttccgagttaattgaaggaaaaattgaagtttcggcaacacagcacattggatggcaagaggcaataatctctaatgtacgtggaactggaatcatcaatgcatttgtcgaagtacttgatttgtcacgtagagatggaaaaataggttctgtacttaataatagcctaatgcatagtggtagttacgcactaacatcattagccatgtttacgtcaattatgcattctgctgctgatcttgagctttatccagctgctgcagctggacatagatcatatgagccaaatggaattactgaacttgatccttatggagcattagcattgcttatgtgtggtgtaaccgtaccatatctcactggtgaaaacaaagatggattatacgatagatttaacaatcaatacatggatcttgagttgtacacttattcgcctagaagttcaatcaaacttccaagtaatgcacgtttcagactaagtctattactatccattcttaatgaagtagtagaacatttcagaagcattcgcaaaacagtcaatggtgcaagcattaatgtattcatgctagataagtatccagctaaagtaaaggaatgtgcaataaaatgcatatcaatttactttacactcactggtgatgaaaataagttaattgacttactgtttaatgacagagaaagatatcttggagtaaactctgagctcacatttccaaatctaccacaagtctttcgtgatattgataatggtagatttggtaatgaggatctcccattgaaaggttcagaagggcgcctaattggtgcagcacacttaaatgttgtcggtacaattgatgctgcaagagcaccaccagcagctaacattgctgatggacttagacaaaacatgatagcagcaaaaatgtcacgcggatatacagtaaacgagtttacagcctatcgaacagatgctcaaaatcgcaccttctcacaggttaggaagattgaagaggcagtgggtaaacgtgtgaaaacagcttatatatcccttcaaactgtacaccatagaattgatttcatcaataataatgatacaatcacttcgatgtttacaatggagacagtaccaacggaggatgaagtcattgattttactactttgcttaacataaactattatgataactttatgcaatacaatcttattgaaattagagacttagtttctaacttacgtgctgctggattaattcaaattgatgacagagttaagtatgtttcaattccacttgaagagacgaagtacgagataattgaacgacctgagcttaaacatgatcaatttgatgcttcatcaatagttgttaacattaaacgcagtaagtttatgagtgagaataagtatacgctatcctcaaacatacctgttttctgtcaagttacagaaaaattgcacttactaaatgttgtcaacggtagaacagtacttgatccacgcgcttttaatcttgcttttacgccaatcatttatgtacacgttacatgtgttacacgtgctcttgtcggtatggaactacttaaagataattatcttgaaggtacaagagccgcagaagcattacataaaaggtcacgtaatttatatactgaaggtcttgtacgtattagggccggtaatggtgtagtcttatctgaaatgaagccagtgacatccagggtaaaagaagaggcaacggttaaagatgaattctcaactcgactgagagtcgtctaattttccaacaagcctcaagggattacctaggacgaaattcacatagggacaaataaaaagctc

SEQ ID NO: 639 - DNA, 3609 bp, Unknown
  derived from dsRNAs of unknown virus
gaatattgttgactatacttgagagagatggaaagagactctagtaaatatcaaggcgctatcccaaaaccgaacaagaagcagatcgaggacggtgatgtggcaaacttcgaaaaggaggagctgagtaatgagctgtatgaaaaagacgggctgccaaagacggtgaaggagatcctattagatccggataagtacgagattgtcattaaaaatgaacagttcatgcagctggtcaaagcggcaaacttggaggtaggcacgcctgcggtgccaaaggatgaaccgccaaaagatgctccgccacccgcagaagaggggacacttgcagtagcgactaagccaaatatccctgaggaccactttgatgagttcaaagatgaggatatgaagtcagagccgccacggaagaaaagcatgttcgaccctaagctaaagatggtaacacgcccgattacggctcctgtggcagtggagtctgtgaaaggttttctcatgtgcaaggcgcacggccttgaagatatgttcgaggaagacttgcccttcaacaagagctggggactacgtttcaaagagatcgctcttccatatcagtcgggcggaacggtcgagccgatgcaatcaaaggatggacttgcggacacttcaaagcacgcctttgtcgttggtcccgagcttgcaccgtttggtgcatcgtcgcatgaacgtgtactttctgatcgagaggtggttggatatacaaaaaccattgaggacgtgggaatgcgcaggaacctactgagtacccgtctggacccgggaaaaatcacgaattttgatagtggtgaaggacgtgatgttaggaatgtagacacggtacttgacctggccacagaagaacgaaaagccgactcgcggatcatcgtccaatcagtgattaccaatccagagtatctgcgcatattgcttcatagcaccaatctgttcaataagctacatctgagcttcaacaattggtgtgcagttcacgaggcagcgggaatcttggatccacggcataagatttatgtagcgaatcagcgccatttcatccaacgtgatgtgctgaatcagtcggaggacatacgtaccgtttatcaggtgcgattcttcgggccaccggggcgtaacaccgacgatttttattactcacaccacccgcaggagccattcgatgtatgctttggtgctctcgaacgctcttctgcgttagctaatgaagaggtcgcacacattgcctcacgggaacgtgggactgtgcagatcgttggtaatcgtggctccgagtgggtgcagatgcttggtgtcgtgacgcctgctgaggggagtgagatggctaggagccttgtgtcaaccctgctgggtggatacagaagcgcttttacagtgaagcccaagccggaggctatgaatgatatcactgcctcactttgtgcggtggcaagtctggccggtatggattataacaccctcatgttggagtcccgttcgcacctattgaacacggcactctcaccgttctactatcagacgtcacagctgtgtcatacgatgcagagtggaggaggaggcagtccagtaggctcaattacgccgcggatctcatcaggaacgttggatataattgctgatttctttgcagcgcgcgacgcaccgaataacaccagggctccgttgatcctgcctaatgtaccgccaaaatacagcaacacaacatcacgtgggtccattcttgcagaaaagatgagaataaaacttgcagcttgcttgaatgaagcgatcagtcgcacctatactcgtcgtcctataatgaaccgtatctataacactcgtgcagggcagctaatgttcccctttgccgttcgtgatgacgtctatgatctgtgtatgcatggagagccagacggcacgtctgtacctagatatagcaccaaggtgcacctgccagaggctgaggccttccagcttctcctgacgacatgggcgcagcttcttgcgcagctacccgaccgtgctccaggaattgacaacgccgttaagagcatgctcgacaaccgtacgcacgtacgcgatagtatggcaattatgacagccgccctaacgatcgggagtcagaatagagagcttcttccgttccagaccgggtttcgggatgctggaggctcacagtgggacattatcaccaacccagtcgacgtggtcgagttgcccttcggtggatggctgtcattctttctgaatggcatctcgtcatccttggttgaaagtaatggcctctatctgaaatacgcggactatgtcatgccaaagatgccatccatgtatccactgtatattggaatggagcgttgcattgttcatgatgtggtgaccggcatcgagcaggatgagagtgatctagaagttcgccgtgaggaagtgatcgacttgattcttctgattatgaagcgctactgggtgactttagatcccgactcgccagacagagttcgaaacctgctgaatcatgcggatgctggaacgcacctccccggcttccctaacacaccggctaccccaagggcaattgctccactgaagctgcctacgtatttcaaaatgccgattgttacacgtccgcgtgccccaggacaagatatcattgagtacgccaataatcctccaagcatctatggggcactcacggagcaagacacaaggcgcgggtttccacttgggcgatacgctccgccgttcactctagcacccaagggtgtcgcaatggctttagaaacggcgaaacactgccaagtgaaaaagttctatattacgaggcgtcccatttcacccatgctagtgacgcaatatgacggaactaaggtgttcctgtacactagtgaggagaatccaatgccagtagtaaagcttgaggacctgattcgtcatcgccccgatggaaaacaaagctggaccgaaacggagcttcgcgccatggcagaccgttattcattggatggtatgttgagtggtgacgatggagagatagttgaatgggaggcgatcgaagtgagcaacgtgctgacaagctttaagtttgaagagcataatgctactgacgatcgcctcgttttcgacaaggttggtatgactattaagcgtgatcgtgagcgtttcagagataacaaatttgaagtgtcagacattccagtatccatgcatgtaatcggagacatgacttcagtgcgtggatatacaccggaagaggagcgccgcatcatgcgctcgctagtccgttatactttagtgccctgggagaccattcgtggctcattgatgcacttcgacggggtgaacgtagatgacgtgaatctgtacgaccacgatatgcgtggcgtgggtgacgagctaaagaaagatctaattagtaatgttcgggtgcgggatgcgcgtcatggtattacacttgcagcatcaatccgtctctctacgcgtaaggttgagaagttcgatgttctcgacactctcgttaagcgaacagtgccaggaacaatctaacaaatctcacggtcacccttgctgaggcaggtatagtaggaatcaacaatgaacatc

SEQ ID NO: 640 - DNA, 3584 bp, Unknown
  derived from dsRNAs of unknown virus
gtaaaacttttattcctttcgaatagaacttagacgaatctgatcttcctgatcggttagttttacatatccacttggttctgtggattcgtcaacatgcaggagaactaaatatgagtgaattgccatcaacagcaatctcagaattttataaagaatattccaaatacacagaattgtgtgaccacaagactgagttaagtaaagaactgtttactaaacttatgacaggtgtcgcaactgaagaggaatacacaaagtttagaaatgagctttatcacgtagctgaactacatgatttgaaacattctaaccttaacttaatgggtttcagtccaactggaatcggaatgccaagactaggtcgtaacatggtcaagcaagccgttgggttatctacaggtatcttaccagtagatgatgtccttgaaactattaaaggtgccgctattgaagcaggaactgaagcagtaggtaaaactgcggctaaagtggctgaacaagtcaagcgtgcagctgagcgtttaggtaatcagaatgaacagacgtcaaacggtggtggaagttctgttaaagcgacaggttttggaagcaatggaaacgaggatattatgtcgattatttcgatgcctcttaacattgattacaaatccggagtagtttctactctgtatcctcctaatcaaaacgtaccaactcgtgactggtctagttttagcaattcagacggtagacttcgttctgctgatcttgcctgtgtaatacagcgtgtacctccgggtaatgcattttcggatgtgtactggaaacaaacgctaattcctaatctccaacttaaagcacaagcatctgttggtttcaacattaatgctgactttaatttttcttatactaaagttgtagcgtactttaatctgttaatgggtgcactaggaaagtatttcttcatggtaaatacttactccgtcattcaaggtactggacaaaacgatgttagtcgtaacgtcttaagacgtatgttccaaacttcagatctacaatatcttgctttacttcgagaaagacttaacgcactaccaatccctccaaagatgattgagcgttcttctttcttatactcaacttacaaatctaatccagatagtaactgttccaataatattggatttatccctgttccgatgacaagtagtagtaataactattactttgatactatcaacatggatcttctttctactatcgaaaatttaggtatccttcttgataatccaaatcactcgcttttcaaaacggtggacatgatggcacgtgttttcccgaattgggtgagtaccacggttggtgcaacacaagaagtacctcaatattcacacgagtttatgaatatattcataaatagtccttgcgatcaatcctcttacttagcttcaagtgcgacagattttaaactaccgtctgtagttaatgatactgataccgtacaattcgctgtttcaggtgaatttaagcgtgaagaattgggtgatcaacaggcagcttgtagtatttacagtgcttcagaccaaacttggtccggtgttttagttccatctgcctcaactttccagttaagtggaaatactattagaactaatcgctatactttcgcatactcaagcacatttgcaaatggtgaacctaactgggtgacatcaaatgtaactgtaaacgcaaccaatggttacggtccactgggcttaagccaaccttacgctaatactgttgttggtagtgattcacatcacgcacctcctttcggtacttatagtgttatgggtaacacagtgcgaagcatgtctcaaccttcaattgattggatggctgaaatgttcgacattggttcactaactcaacgtgattcaggatcgaatcgacgcggtggtggtcgtagaaacaataatcgttacagacgtaatcgtagtggtaacgatatcccgcctgctgaaatgtaaatagattaggagttaaattatgaagttaagccgcatacttgatcatacatcagaaatgtttaatttaaataacactgaaacaggtgaactatcccgcatacttcaaagacttgttaaaggtagcttggacacacctaatatttgcagtcctatcctggagaagttaggtgaagcgaaagttctagatggttggaactcggttttcgacaatcacaagtctgaaattaatgatactctaaattcaattgagatgaatgagaaaacaaagttcgggagtagaagtagagctaaaccttggagtgatatcaaaggtgattttctagaattctggaacgtaagttcaactcccgttaacctaaagcctctcaaacccgaaatacaaggtagacttcgtccatgggatttaaagcgagtgattagtgttattaaaaatagtactcaatcaggtcttcccttccttgtaaagaaaggtttagtgaaggataaattcctagatgaagcttatttgattagtgagtggctgagaaaatatgctgctgttccttttattaggacacaagaaatgcttaaaacgcgcgtagtttggggtattcctattgcgaatatcatttacgaaggtgctttcttttacccctttcttgaatatcaaaagaagttatcctggagagtggctttacttggacccgatgcagtagatgaagtagcctctgctatggttataaaagcagtatctcaaggtgaaatgctagtgtcgatggacttcgcttcctacgatagatcgttaggacctaatctacaatctctctacgatgaatataagtgtagtgtatttcagcctatgtactgtgatactatattagagatcggtgaacgtcgtgtgaacatttctatgattacacctgatggccttaaaagtggacctcacggattaccgagtggatcagctgataccaatgaagctggatctgttattcaagctaccgttgccaatgacactggtcttgtcggtattggtggtgactcaagtcaatttcacggtgatgactcgattgctcgcttagcaggcatggctgaagtcgagagttatatcgctagtttcgaacgcctgaaacttgaagtcaacagaactaaaacttacattgcaagtaattttatcgtattcttgcaacgtctttatcatattgactatattaaagacggtaaaattggtgggatttattctacttacagagccctaaatagaataatgaactttgaaagatttacagccttcttggatgatggtattgatggtaaagacttcaatgctattagaacaatctcaattctagaaaattgcaaattccatcccctatttgaagagtttgtcacttatgtatggagtctagataagtataatcttaaattttccgaaaacggacttagcaagtatgtagagatgatgcgacagtctgagggtacggatggccttattcgaaatcagtatggaacagaggtgagtggtattcattccttcgaatccttcaagattatcgaaaagttaaataaggtagggtaaaacctgggagaaaagcctatgcttgactcctc

SEQ ID NO: 641 - DNA, 3554 bp, Unknown
  derived from dsRNAs of unknown virus
gtaaattttcctctcggaaactcctttcccctcctcaagggtcgttacaacgaaaggcacaaactaaaacaatcatttatgaaagataactctgacaacatcagtaatcttagtaaattgggtttctctactgatgaaattcaattactaacggatgctgaaaacaacaaacttgatgattccaaagccgaagagttgcatgcagcacttcgcaaaatacacaatattttaggaacattaacgatcaaacataatgaagaaatcgagaaatcaagcggcaagctaggtttcatcccaggtgttaatccaatcactaagttcgcaactagtgtagcggctgacgcacttggactagccggtaactcaccaattgaactgatggacgagggcatggctgccttaggtcgagcaggttcatcggcaattaacgctaagaccggaatgaaagtttcgcctgacgtattgacgaaaaccatgacttctcttttgaacggcgttgctgacgacgtattaacaaaaggatttactggtgctggtggtggtaactccggtggcaataccaataatccatactctcctggagctatggctgctggtactggtttcactttcatacctaaacctatggaaatcagattcacgccaaatgtacctaatactgtatatggagaagtaactgtcgcaccaaacgacgaattatcttccacttcagatcagaatattagggcaagaatgcacatgaattgtattgatttatctttaccttcatttggattcggactaaatgacgcaaatgttaatccagtaagtagaaccgttactacttggtttagaactgtctttacgcctaatttacaaactagagcgcaagcgagcgtagctttcaacatcaatgcacaaactcacttcactgctgacagattgcatacgtacgttaacacagtgcttaaagcactatctatttattacttttatgcacatacttacgcatatactgccatctctacgaataagaacactgcgatgtatgaattgcgtgaaatcttttcgacttctgatttacagaaccttcgtttattagaagagagacttaatggaatgccgattcctccgaaattgaatgaactttgttactggatgtttgatatttaccgatcaagctcagttgctggatctgatttaatcaggttagcaccttttggtatcaaaggcgcagattctggggatactgttgccactcaaattattgatggtccaacacttatcaaaactcaacttaatgctttgagtgacttaaactctgacggaacttcgaacggcagaaaagttttagttactggtgatttcttagcacgcgtttgtcctgattgggtaaacgttaaagttggttcttcagccggtattccattacatgatccagcattaactactttattctggaaccagcaagtaacttacggacaagctgatgatgtccctacttacatgccagtctttgttgataacaacacagacacggcttacaactcgtattgtgaagaattagatggtgtagtccaatctatgttctcttggtacagtgctgcttcaactagtaagtttaatgttggctgggtgaaagccattccttgtgacgttggtggccaatggacaaatcgttttacttatggtaatggtaatgcgggatttggtttctacagttacacttacacccctaatatctgggcgatgcgtaatgatacctaccgacctggtggttctacaggtactcaactgactaacattgtcggtactaaccgatgtgaagcagttccagttcttggaatgaacgttaattccgttcaagaggcaactgtctcagcactagattatttacttagtattggtcaagtagggtctaaagccccactttcttctgatattgatgacgagaaacctttaaaaggtcaacgtcgaggtagaagacgcaaataattgaatttaaattgattatgaacaaaagaattacatcccttcctttcttagatgttattaatgaacttaaccttggtaataacacttatgctaaagagaagctttctaatcttttgaccagaacaactgttggtagcaaggatattcttgtctctcctattggcaaatatggtccggataagcttttaagtgaatggcgttccatatttgaggaagcagtaaattcaggtaaggtaagtaatgaagtacttattggcatagaagatgcacaagctgataaatttagtccacgttctattgctttaccttggactaaacgtaaagctaatgttgatcagtattttatcgaaacaaacatagattactcaagtctagactgttcaactagtgcgagtgagagtttgagacctcttaactacattaatgcttccaagtttataaagaaatcaactagtgctggtttgcctagtatgagaaagaaaggtgaagtactcgaagaaaccgttaaagacattgagtactacttagatcgtgaagatcctgctgttctttatactcgaactcaagaaagcgcgaaaactagagacgtcttcggtgttcctcttgctgacgtattaaacgagatgcgttattatcgccctattcttgagttccagaagaaattaatatggcgttctgctttatcaggacccgaccgagttgctaagcatctaactgaaattattgaacgagccattagtgaaggtttgacactgatttcaatcgatttctccgcttacgacactaccataaaacaaggactacagttcaaagttggacaatattataagtcactatttcaaaagagttatcactcagaaatagataatattataagacggaagagtaccataggacttgtcacaccagatggcgttatgactggacctcatggcgaaccgtccggatctgcattcacaaatgaagatgatagtttagctcaacactgtatagcaatgtcatccaatgcaatcatagaagatcttttagatattcaaggtgatgatggcgtttatgccgttaaaccagagactgttaattcactctacaatactttcaagaagtatggtttaaatgtaaatgttgataaatcgtttgaaagtccgaactatctcgtatatctgcagaatctgtatcatcccgattttaagagggacggtgtaatcggtggagtctatcctactttcagagctttgaataggatagtttatcaagagcgatgggctaactttgaggattacggcataaaaggtaaagattattatgccattagaacacttagtattctagaaaattgtaagaatcatcctctgtttgaggagttagtcaaatttatcctttctaaggacaaatacaacctagaagtttcttctcgtggtgtcaatgaatatgttaagttcatgattgacacagagggcacagaaggactgataattaaccagtacggtgacgacctttcgggcattcgaaattggcagtcattccgtcttgttaggtctttatcaggaagctagtactctgggagttgtcgactccccccc

SEQ ID NO: 642 - DNA, 3520 bp, Unknown
  derived from dsRNAs of unknown virus
gtaaaatttacaacttaaatgttgccccctcccggggtttaccccggtcccgttttacacgagggataataattaaaagaaacatatttatgacactaaatacagatttcattaattcattaaacaaggatttacctgaagtcgctaaaacgattaaggaattctatgaatctaaagaagatattacatctgaagagattcagaaactgattaactccttaaagttaatcaaaatacacagagaaaataaaggacacaaaaactatgttggttttgtacctactggattgaaagttccaactggaatgagagttcctggacaaggaaacttcgttatgcaagatgcagctatgaacgcagcagccggagcagcacgatcaatcttcagtgatatacaagctggacgtaagccaatgtcaagacagagcgcattaagcgcggttgtagctggagcacaaagtgcattcccagatatcgacttttctggatttacagaagcaccaaacacaccaggtggtggtggcggtacttcaataggtaattcaccaatggcgaattcaccttataatggacaaggatttatctttcaacctaaaccgttagaagttagatacagaccagatttaccgaacactatttatggagaagttgttcctgaagcgaaagccgactttaatgacggtaacgataatggaactcaatctactattaactcacgaattgttgctcatttaacgcaagcgaatatttctattcctagccagaatacagcagctggtactactatcaataattattttgatgatgtttggattccgacagttcaactgaaagctcaaggtagtgttagttttaacattaatgcctcagcaaatttcagttctgctacaatgcgtgattatctaactcgtatcatcgatgccctttcgatatactacttctttgctcacacatacggatattgtacaatatctagtaacagaaacccaggtatatttaacttaagagagatgttcgctacgtcggatgttcaaaacttagcgctattacaagagagattacaagcgttaccgatccctcctcgtattaacgaattgttatattggttctacaatatttatcgagaagattcaattgctggatctaacttaatcatgaatattcctactattcttacgaatggtcaggcagacccaaatgatcctgcgaaaggacttgccaatcaagcactggtttcacaacaactagcttcgcttgcggatcctggattcattaatacaacaaacttcctaatgagagtttgtcctaactggtctaacacacaagttggatctgctatgggtattgttgaacatgatccgaacttcacgactacatggaagaatgaaccattctcaggtatcactaagttagaagatactggagtttcgttagtttatacaattccacaaatgggaagtgcgaatcttgatgtaccttattcttcatttgttgaatcattaagtggtggtattcaatcactacattcaatttatagcaccacaaacaatgcttaccaaggatttgttggtccattagtttctacaacaggtttacaattcggtactaatagatggtcttatctaaatagtagcggtgttcctggagctggagttgatggatggttcgatgctacttggttccaaagagctcaaacgtctagaaacgagacttacactttctctcaaaataagattgtatctcgaaactttatggcacaaacagttagtggtagtacgccagttgaaggtattaatttaaattcaaatgcgcaaattactgctgaattcattcgctggttaacgcaacttgatgaaataggatcaagagctaaaatggcaccagatgcaatgaaaggtggcaataaaggtagatctagaaagagaaaataagcattatggtacaaattaacaagaacgaaacaatttcatcccttccttacagcgatatcattaatgaacttgacttaaacggaaatgttctcgccaaacagaagctttcaaatctattagttcgtacatcagttggttctaacgacgtgttagtttcacctattggtagacccgatccacataagcttttaaatgaatggaccaaaatctacaatagttgtaaagatgagaaagttaattctgtattaaacgaattagagctatcacagaaggataaattctctccccgatcgattgccaaaccatggagtgaaaggaaagaagatactttggattattttgctgaaaataatgtagactactccggcctatcttgccaaagtatcacttctgacaagggtattcttcgccctttaagtgtagaaaacgcttctaaatatatcaagaaatccacttctgcaggtttacctagcatgcgtaagaaaggtgaggttttagctgaaactattgaaaacttagagtattttctaaatagacgtgatccagcagtattatttacgcgtactcaagaacaaggtaaaactcgatctgtatttggaattccgttagcggatgttctttacgaaatgagattttatcgtcctattcttgactatcaaaagcgactaccatggagaagtgccttattaggcccgaatgcagttgcgaagcatttgtccgaaataatcgatgtcgccattagtaaaggattgactcttatttcgatggatttcagtaattacgatcgttctattaaacaaggtttacaattcaaagttggtgaatattattctaacctttatcaaaataagtataatgatgaaattaataatattattcagcgtaaaagtactattggattagtaacgccaagcggcacactaaatggaccacatggtgagccgtcaggttccgcatttactaatgaagatgatagcatagcccaatattgtatcgcacacaacagtggtactttaacagaagggctttatgatattcaaggtgatgatggagtatacgctattgacccagataaagttgactcattctttaacatattttctaaatatggacttgaggttaatgaaagcaagtcgtatcaatctccgaactacctaatctatctacagaacttgtttcatcctgattacaggaagaatggagaaatttgtggtatttatcctacttatcgtgcattaaacaggataatatatcaagaacgttggtcgaatttcgaggattacgatttggatggtagagattactatgcaattcgaactctaagcattttagagaattgtaagaatcatcctctgtttgagaaattcgtaaaatttatactttctaaggataaatactccctgaaagttacttctgcagggatttcagagtacgttaagttcatctctgaaactgaaggtgcagaaggccagttagttaaccagtatggcgacgacatccgtggtatccgtggatgggaatcgttcaaactagttaggtcactttctggtgcataattacttcggggaaagaatatattctttcctctc

SEQ ID NO: 643 - DNA, 3480 bp, Unknown
  derived from dsRNAs of unknown virus
gtaaataaaatacattcagtatacccttttacacttcaatttgggtttaaaaaattaattaaatatggatacagacgattcattcgatacgttcgaccagacagagcaggagatgctcgaaacggtgaacgagattttaagcggtttagatgctgattttcagttaactgaacaagacgtgcacgcttggtactctagaaactggaggactacaaacatgtcaaaagcgatcactttagttgaaaactacggtatagatctaaagtttgtcgctggtggtggccgagttattggcgcaaccatcgcaccttgggcgataaatacgttcaactcttggggagaggtagcagctcaagaggtcatgtcgatagttgccggacaaggtaacagaattcgacgtggtggtgaaaactccatcaaacgcgtaatgcaggggataaagaacagggccaacgcgaccaaagaggctggacatcgcgaacagactgttgaaggtacttcagatggtactggagatagaactctatttgtgaacagaggtgaggctgacttagctttcattccttctgaaattccagaggtacagtcaactagagttgttgaaattccaaacacaacttacacgaaagtgactattacaccgggcaagtatacaacttcaaacattgagcgaacaccgcaatctgcttacttagcaggcatgcagtggtcacttccgcctagtactacttacgcttctacgttttggactaactgggttatgaaatttcagttacttgcacaagcaagaacgaatttctcagtcgatgctacgaataaattttcggaagctaacctaactagttacgttaacaagctatctcttgctatatcaacgtacttgttctatgcgaatacatacacattctgtgcattagaagggaagaatacagctagaaataagcttagacttttctttgatacggatgatatgcagtatcttgcattacttaagtctagacttgatgatcttccgatcccacctagactttacaatgagttgtctcacttatatgcgatctatcacactagtgagcactcatctacttcatcaacttacagcttttcacctatgacattatttggtgatactgcaagacagttaaattctttacctacatcaacgaatactcaaggtattagacactgtctaagtaataatgtattagctgatgaaaattttattaagacaacagacatgatggctagagttatgccagaatggttagatgtaaaagtaggctcttctcagtatagtgcccacatgtacgacgctgaccatcttaacttattcatcaattcacctggcgtatcatcttcacctgacacagacagtacaactgttcgttataatccaacgtatgctggtgacaattcagttgaagataagcactatgtcatggctaacgcacacggtaaagatatcagaggtgatcaacaagctatgtggagttgtttagatacgcaagcacctggtgaaccatggtctggctacttagttccagttacttcagcgactggtgatggtcatgcctctaacagattcaagtatatcgaaggatccgctggtactgctaagtggagtttcgacaatcaccattcaggttttgcttctggtattgacgttgcggctggatctaacatctatgctaacactttcggtaacgaagctttacaacgtaacacacctttaggtacttacggggttcttggcatgagcacagaatcacaaagaattcctcaagataaataccttgacttcattctagatatcggtacacctagtggggatactggtaaagataagaaaattaaatatagaggtaaacgtaaaaagtaattatgtcaaagaatttcagtataagacgcacactcctacaagttgagcgatttggcgtgtcctccgctgccttaactagattgtccctctttctgaatcgcttagtctcaggtaatctagaagacccgcctcttatctctgcgactgctgagagacgtggatcagaaaagattctttcagatttcgatggtatatttgaaaggaataagcaaattctaaatgaaaatctactcaaaatcgaactagaccaaagaggtaaatatggttcacgttcaagcgctaaaccttgggtagacgttaaaactagcactcttgccaccttcgacaagagtacaatctcatcacttcccaagcctttgacagctgctgggaatcgctctaatagattaagagcgttttcattacctaaggtcatacctcttattaagaatatgactaattcaggacttaaagatatggttccgaaggggaatattaaggataaatatttgagcgaaagttatttaatggaagagttacgtcttaacctaccatgtgtacctttcatcagaacgcaagagatgcttaagacgcgtgtcgtttggggattcccaatttgccaagttatatatgaaggcactttgttctaccctctacttgtgtttgctaagtctattaattggttgaaggccttaattggtcccgttgaagtggacgactttgtcgttaatcaagttaaagagtgtttcaactctggtggcttgcttatgagtatcgatttcagtaactacgacactagcgtgaagaaggaacttcaaggtctagctttccactattttagatctttgtttcaacgtggcgagtcagataagtttgatctcattgaagagagattttcaaacattccacttgtcacacctgatggtatcattgaaggcgaacatggtataccatcaggctccgcttttactaatatagtgggttctatcgtccaggcgactgtagcgttagattctggtttggttgatgaagaaaagtttcaagtcttaggtgatgacggtatctattgtctgcctgatgagcgttcagctcaagagttaatctcaaggtttgaagcctgtggactcattgttaatgagtcgaaatcttatagatcaacagagtattgcgtgtatctccaaaaattatacgatatctattatatcgagcgtggtgtgaatggtggtatctatcctgtttatcgtgcattaaatagaatagtacatcctgaaagatttgttgactttggtaaattctctattgctgggaaagactacttttccattagaactctttcaattttagagaattgtaagtaccacccaatgtttgaagagttaacgaaatttgtcttgtcattagacaaatataatttgcaatttagcgatcaatctctatctagatttatagaaatgactgagaaaagagagggtgtcgcggacattattcgtaatcagtatggcgatgacttgaagggaatcagagacttcgagtcgtataagctggtgaagaaattaatgtctggtgagctaacatcttgtggtaagatgggttaaaagtaaaactggggagctcaccccccc

SEQ ID NO: 644 - DNA, 3434 bp, Unknown
  derived from dsRNAs of unknown virus
ggaaaataaaatgtttatttacatattcgattagcttcttcgaagcttgttcacgcgaatcggtttcttcctctgcgaagaaaattttcttaacgtgaacgtttacaaacctaactcattacctatgacgatagataataacgagtctaagtatagcgacgacgttaagtttcttaaaactaaggaagcttacaactgttactgtgcttacgctgctgagttacacaatctcctagatctaccttcttatgaagagtgggttaactgtattgaaagcgagaatccgcacgaaaactttggtgtgagagcagctttcagagctagaccggattttggtggattagcaggcatggcagctggtatagttgccagaaatatgggtgttgatacctcatctgcagatgctgcaattagaagtgcagctcggatacttgatcgcgaagccacgaaacgtagtaatggcagaggtaaatttacttttactgatggcggtgatggcggtacgacaaaagtgaactactctggtggttcagcttttaacccccaaggtcttagcttaaacgctagaccaattgattcatcttggagaacaggaattaaggttaattacgaccctaaatactaccttgatggaggagacgatacttcgcctcttatgatgaaagcatttacacctcttatgggtgttagttctactgatattgatgatagagttcagaattattttgaatctaaaattatgtcagattggattacttactttcaacttaatggtagatggaacttatatacacaaggtacttttagcgctacacgtttcaaagactattggaacattgtttcgcaggccttagccatcaactatttctatgattcagtcgctgcacattttagactagatataaatagaaacgaaggaatgattgatttatacagtcagcttagtccgtctgagctaaatcagttattcatacttcagaacacgcttaattcaattcctcttcctccagagttaaatgaaatgtgctttaagttatacaataactacaagcagtctcacaaccctggatcacctttaattaagctgtgtcctattgattcaatggtcagctctgattcatatgtaacttttggtgagtctaacaaagtcgctgatataatagcgaagatgaaacagacttcatttagagacgttcaagctgtactcgctcaggctaagccagagtgggcaactgacgtaaaactctatagttacactggtttaccaaactttgatgcggatttcttaactttatttgttaatactgagtacatttgtaaaactgcaaatggaatagtatccgtgccttctataactaagtcagctgacgaatgggtatataacattcacactgacgctcctgatggatggacgcaagcattatctaatgttactgtcggtttatctcagagagcacctggtattggtggacctaaaactatgcttccaggcgacactggcgctcttgctccattaatttggtcatacactagcgctgttcctggtgagcttcttgctactagctgtgttatctatactattgacaacgatttagagagtgctcctaaacgtggcttctggccaatttctaagagaactagatatcaatcactgtctggtaatacttatactatcctggatagagatcccactgctattggttatcaaaagtttggcacttcacgtgtacttcctatgactggtaacactaactatgttgctgctcaacaacttcttgacttaattgttagtcctaatcaaagtgccggtaatattatgcttggtgatgatagtatggattctgacaaaccaacaagacctagaagaagaagaacacgtaaataagttcaaactttaattcatctttattacttatgcaaaccttacctcttgatcctttactatctgaattaggaaaagatgaagcagcgaagctttcccagagtttgaaccgtattgttaaaggcaatgacacagtgctagtcacacccgttgcagagcgagtaggccctgatgacattaaaagatcttggaataaggtattccaggcgaatattggtttaatgaatgatgagttgattgcaatcgaagaagcgcagaagcttaaatttggtcctaggtctatagcaaaaccatggagtgaaattcgcgctacagcattgtcttcattcgaactgaagaacattgattgctcgcatttagaaagcaagccacgagcatcttccgacattggtcggttaaggcctgttagtatagaaacctcagcgaagagagtccgtaaagacactcaaagtggacccccttattttgcaaagaaaggggcggtattgtctcagacacttgacaacctgcctgaacagtacgatagaaattgggaaatggctcccgctatccgtactcaagagcaaggtaagactagattagttaagatatttccgtttagtgatatattaattgagaatagttatttccttcctttatttgaatacacacgccgccagcctggtttctctgcgatgattggtccagacgcagtcgacgtttcaatgacacgcttaatctccgaagctgttagactaaaccaatattgtttgtcaggagacatcgatactttcgacgattcttgtaatgcaagtttgcaacataatgcattcactgagctttctcagttattgcaacctgcataccgtcaaggattttcagaggttgaacgccgttttctaaccaaaccacttattacacctgaaggtatatggactggagaacacggaatccctagtggatctaatttcaccaatattattggttcaaagattaatcagcaagtttgtagccatccagctgaattatctgagtttcttggcgatgatctaggattagtgaccgctagaccagagaagatatttgaacgctatgataattgtggacttacgatgaacgaaagtaaaacgatgattaaaccatcatcctttgtttatttacaaagatattatcaccctgactacgtgatagatgggattgtgcacggtatataccctctttggagagcattaaataggttatgttatcccgagcgctttacggatttcaacgagtttgatctgactggttcaggttactttgctatacgcagtcttagtatcatggaaaactgcaaataccacccgttgttcgagatattcgttaaattctggttaaaatatgagcgttacgctgttccctcaaacagatcgattacacagtatgttaagatgtggaaatcgaagaatgggtctctgggaactactaatcaatacggtgacaatccttctggaattcgtaacttcagaagttttcaacttgttgtgaagtactcataagagttacagctcataatacttagtattatgagtcc

SEQ ID NO: 645 - DNA, 3464 bp, Unknown
  derived from dsRNAs of unknown virus
gaatatcattggtagaatctttaaaaacagatgtcaaacgtaaccgaaaaatataaaggtaaactcccacgccctgctaaggaccaaagcgtcaaagagttcgaagaagaggaaatcaagccagatgccgaatacactgaatttaagagtgtgaaggacattttggccaaacccgattatttcgagccaatcattaatacaccagaattcataagtatgctggagaaggaaggaattgagattccgaccttttctacgccatctaaagaagtaaaggtggatggtgataagaaggaaaaggcaattaaacaggaagaggaacctaaagaatcgatgaagaacactgacgaagaggaacccaaggcatcaattgatgttgtaatggtgccttcactggaggaaatttcacctactgattcaatgagtccggttgaagaaatgccttctaaggcccacttcgaaccagtatatcgcagaatcgtacacactttaactaaaccagtatcctttgatgttacacatggtttggctacattgaacaacacaggtcttgaggacatgtatatcgattacagtggagatcgaacgactaagaaaggtcgtgttcttttcagatggctgcagacgtatagacctatgggcagagtcgaatcgataaagtatgattcctctaccgggcttgtagattcctcgaatcacagctacgttttcacttccgaagtcgcaggtaacagcgcgatgtcacatgcgtatgaaattaactcactgcggccgaaagtggaggtggcgcaaccaggcttcagggcaaacgtatttgcagatgcaacgattcctgatgtgataacctcacaagtggatggacgtgttatcgatttatcgattaattcacgccctattggttcgcggataaagtcagctgatgtgattatgaatccatggcgagcaccaatcatgcttcgtgacatggctgcgtataattacatgactctatccttcaatgattggaaggatgtccacattgattatataaatcagggaatgctgagatacgtacgtgagcgcaatgctaaggagcgagatgtaattactaacacaaccctacagaagactgcgtacgatagatacatcattggtaacgctggcgctaatagcgtaacgtactactatgaaacgataccagactacgcacccattctgtgtgagtccgtccttggtagatctttcagtaaggcaagcgaagctatgtccacaattgcaccttcgcagcgttcaatttcaacgaacattacaaacaggcaggcttcaagcatgctgctaaacctgactgcggtgcaaccaagtgctggagcgaacatgatgcgcgatcttggcgcctacttgctcggtggtaagcgccatgttctggaggttgatgtagatgacggagctacaaagacaccattgctaaacgccttgagtagcatggcgtcgttaattgtgcttgatagacgattcctagatgagcggagcaagaggcagctacttgtaaacgtactcctccccttctatgatgagtttcctactactagaattcaaccgggccaacgtggtcaacccggcgagaggaatgtttcaagaagcgttcacgatatcgctgatgagtttctagggaacgcggctaacgctaacctcccggaagtcaccaaaatggtggatcttgctggtcgtggtagggcgaaaggacgtgaaatcagaatgatgctgcaagatttgctcaggaatgttatggtaattaagtttgaacaacttggtatgacggataacatgttcaagactggtgcaggccgtccttatatgccgttttcgtcacgtgacgatatcactgacatcgtactgtttggtacccgaactgacggtgaagaatcacgtatgcatgaaatggcatcctatcgaccaggcgctataagaatggcgaacgcgcttgagagattcgcagacgtacttggacgtcttagacagttcgatggactaggcttggctgttagtgaggcgatgaaaaccagttcacacttacctgcatctatggctatctttactgattccttcgtgcatggatcagttcacactgatctgctgcctgcaactgctcaggtacgatacgagaagtcagttgggtcggttgtccttccatttgatggcgcactctcattcctgctttatggaattggatcttcagagatgtcagcgagtaatgattccttcgtaaggttcaaatcgttatcctctccaacaatgccatcattgtatccggcatacctgtacttcgagagggcgattgtaggcagtgcctacgctgcattcaaagatgatcttctgatcacgcacttcgacatggtggtaagcgtgtgtctggatgctctgaaggtgtatttcaacgccgttgatcccgattcagcgagtcgcatcacatacctattcgatgagagggatacccttgagaacgaatacctagaactacctgcatcccttacatcatcaatcttttcgacgcatcaatacatgccaaggatgggagctaatgggccacaaaagcttccagggtccttcaacactaacgaacagatacatgaactaaatgaaatggtgaacccttacaaggattcactcgatgcagctgacaaaataataactaaattgtacatcgatttcaagcctcttgccccgattgatattgagacatataatcagggtactactcttgtatacaccaaagagggccatgatgatgcacgttatctaagcttaaaggaaatagtcaaagaggcaagatatattgattccttagaattgagcattgatggaattaagaacatggctatcgcccaccttagaaggatggaaaatgaggaggagctcaatatgtacgatggtgtcatggtcgacactttgatgacgacctttaagttcgtagagcataagggtctaagtgatatggtagtggatactccaaaaatcaagattgacagaaacccacgcatgcttgatactgacttcgaagtgtcagaggtatcgatttattatcatcgcgtgacggatagacagggggacttaagtaacccagcgaaacgccgtgagctcgattatttgagtgggtttctgacttacgtgagtgtaagcaggaatgaaatccagaaaagtttaattaacttcgatcacgtggatcctatggatccatcaatctataaagttattagggaccagaacgagaatgtccgccttgaaccgaacgcgctttccagcgtccgaattagagatgggcgtggaattacctatgccggtactatgactctgtctactagagaatccgaggacattggaattaccacatcacttaacccaaaggaagagttttgaggtagtaccatgcactcatgggaaaagattttaaagtaaagggattctatacggaaccaatgtgaaacatc

SEQ ID NO: 646 - DNA, 3398 bp, Unknown
  derived from dsRNAs of unknown virus
taaaacctggctgaggcagcacaattatttagatttacgaacaaacatgggtacaggaataaaaaagagaccgatgtctcaagtagaacttgaggaaatgaaagttaagattaaagttgtatatttagaagaaggacagactgaagatgaagcaattgaagaagaagccaaagataaaaaagaaggtgaagagatctatctggtagttttggataaaggagagaagctaccttccgataaagaagaaaaattacaaggttattcagttgataatccttatcatgatgaaaaggaagaacaaagttcagatagtaacaaggaacaaaaaccaaactcgaccacgactcaagtgagtgatatcatcgcaaaacacgatgttgaacccgtacctgaagtgaaagttgatgatccatcatcaagggtactagacattgcacaaccagtagataactaccttactggagtaaaatacatggatattacacctgaaacgattaccgacaaaacattcatgaccctagatgcaaaagatgacctaggttatatggagcattcaattagacaggctggtgcggtcgagaataattataaatttatgactaggaatctgggttcacgtccagctggtaaccatctaggaatcatgttagacatcgtagacgagtcgttgactcgtgcacgtcaaccaaagaaatactacatcgctcccaaaaagaagaattacgatttgaggtatcaagttcaaccccaactactctgtgacgtaggagtggtggaaaggttacaggcattgcaaactgaactgttagatagtaataaattcattcaaggacaaacaccagaacaaagacgtattagagcaaaagcattagatgatgtaattgaagagttgactctgaagagtagtgatgattcgcgtccaaagggattcgatgatcctatccctacgaaggaatttgatactctatgtgatcaaaagatccttgatcttaaaatgaatattgcggaaatcgataaggaatgtatggtagacgaatcatactacgatccgatttatactgaactacagacaacagataaacaggttgcaagaccagatccagaatacatcaagcataggaaggaattttatgatacgaaggtggaattgcatcgaccagatctgatgacacaatttctacaacatcctagaaatagagaatttgccggtaaggtcacaatcccccaaattatggattcagcatatcgaggtgcagtactaccactatctaatgtcggagacacatctagtgattttgctactagtttagggatgagtgcgacgactgtatcatctgatggcaagctagcgaatatggcatcggctgcaactgcatcacgctttctgcatgattatatcggagcactacttcatgaagatgtatggctaaggtacccactaattagtacgcaacgtatgtacacacagtttgatctagctattatgatggatgcactattttatccgtgtatgttgaattttctagtggttagttttgaagatattagagcgcttcgtaattacgtctattatttcgtggttagacctgtctttgatgtgactgacattctcggtgataatgattccggaaaagacatgttgcatgattttctggtcggaggcatgactggtgttcaagatagatcaaagagagaattatttggtgccatgcgtaggtactttggcacagcagattattctgagctgagtgcacagaacagagaacagtcattcaccggtgttccaaatgactatacttcgaatttgtctaacgaacgtggtgcgtataaggaggtagctattgatggagtacttgatgactacatcttcagggagaagcgtgatttgctattttgttcaacacggcatggaaaacctggaggtgtgatgttgaatggaaacatgcctactgtgtctgagaaaccacgtgtgggtatttggacacatgcaaatgaatttgctaataagttccacactgttatgagtgatgcaaatatgcgtcgtgttatcgctgccgttgatggtaatactattatatccatggcaaagatcttcaagaaagtaatcgaaacacgtaccgtaggtttccagcaccgtttgaatgaaatgaattattttacacactatatgggaaagtttggttttgcatttccaaaaagtattctgcagtccctaaattatgactgggatcgtacacctgaattcaaggagattcaaccaggatcaattttctccagtgttgcattgacaactgtttctgatcttcgctcagtggtactaccggatgcgagtctattggtggattcactaaacatgtataataatttggaggaattcatggtgatgaaacagttggtatatggtacatatagtccagcggcacttcaagaatacgcacagtacgataggcctatcaagagagaagataatactgataagaaactcctaatgaaagcgttcgaattgtatggtggatcatcacctataattaatgcgttgcttaaagaaattaatgcagttacgctagattatttcgattcgtggtactttcccgatgaggagatcagacgtgacgtcatgcctaaacacactctaacgcgaaaatttatgctatatttccaatatctaaatgatccggacgttaggacatcttatggactaaccgatagtttctggctatcaaggcttgaaccagatgagaatattgatgaggatacaaatggtgggttgacaagaaaaacacgcttcaaggcaattcgacgagtagacacaaagcctgataatgataccgctacacacacatataatgcagaggagttctttaatacatatgtgcagggagaagatttcgatgcactatttaaacatatgcgtgctattaagaaaggtgaggctcatgtaaaagtgaacatgccagtacgatggtctatcggtgaaatgaatccaactgcagcagatgaactatcatcgaaggaagcatttcctatttcatggacacgagattcagccatgtcagtcagtgccaaagatatcacattgaattattggccatcatatacggttactggtgaacgcgagtttgatgagaaatacatgttcactaatgataaatacgcaagattgggattctctcccatcatggtaacagatgatcgattcactacgatggaagacctactcattaagggtaaactgattaaaaaggttaaaaatataccagaacgaccattgacacttcgtccaaaacgtgaatattacaacccaatgatgtatgacactggtaatctatagaatttaattgtcgtaccaagtatataagtaataaatcaaaatatgtgccagtcacatgaacaatacc

SEQ ID NO: 647 - DNA, 3246 bp, Unknown
  derived from dsRNAs of unknown virus
gtaatgaaacgatgagttttattgcaaccaatgtgataaatgaataataacgatattatacttggaatgatcttagctgcgtctgaggccaatcgtatggccaaaatgagtgcaggcgagatcgttagtaatatgaccactgaagagttcacggccctctgcgcggaccggtttaagtaccgagaaaacgttggggaaatggaaaaggaactagaaaccctgcggaatctattgtttaataactccgcacgagagtgcctagtatccataccaccatccgtctacactttggctgagaaagcgaggtgcgcagctacatacgcccatcacgagtacaccgacatggttgaagtcatccatgacggcgtgttgtaccaggagcattcgtgcgattgcgggtacagtgtgattcaagctttcaatgtaaatagttcaggcaaaatcactggaccgtatcagtatgactttacggaggagtttatgcgagcattaccccaaagggagcagatcaagcactcggaaatcgcgcacaccgatgacatgacgcttggtgtacatatgcccgcaaaaccacacgacatggacctagaaggggggccattttaatgaccccctgggaaggaagaatttctagtaaggtagccgagttgtggcgtcgcgttctggagcaagcaaaagcttcaggagttaccgtgccgcccaaatacctacaggctatcccaaaagagtttactaagtttggttatttcgagccactcgtagacatgttgatcgctcacgaaccctccgaagttatgggcaaacaacgaaccgttgttgagtatattgataaggtcttggcaaagaagctaaaatggaagaaggttcaaaacgccgccgaccgtgagaagcaactcggtatgttccaatcgtgaaatacccgtcgtttactccggtggcaaagaacttttctctcgctatgcaagtaggtgaacttaaacggttagtccagcattcgagagcgcaaccagattggcagggatcgtccctacgtgatgaagttgcaggtgaagtcacgtcatacggtgtacatggttacgtgaaccctatgtttatcatgggccacgcaagtgtcgtagcgggcacaatgaatatgccatggacagctaaggacccgtcgaccgggaagatccagcatttgccactccctgaccgtgactatgttaacgcatggccacaagcccgcgatgagatgatatctcaaggcttctacctaacaccctcacatatgctagtggggtcacgttctgctggtggaagtttcgcaaacggggaaggctgtttacaaatcggtaacagcgcgggagccgcaggcttcccgtacacaggtgaaaagtatgcacgcgagctcacgtcagacggagatcgtgcatccaaggggaacacggcgaagcgagaaatcgcagcgctcgttgactgggttcgtgccggtcaaccgtggtccgggcctctgtacgacaggattgcacagccagcaaccatgacttctcgtggtgatgcgaaggtggatatagatttagcaatatttgcgacgtctttactcgaagccggatatccactggcccacatgttgatgcccggaagaggcattgtgattgttccaggcgtggcaacgctaatggaaggtttgatcggcggcccgttcttggaaatgctcaacatcttcgatgttggtaagtatgacctacgggaaggccgtatactgaaatcacgtatcttgaagctcttcgatttactccaaatggggtacgatgtagtttctggtgatacagaacggtgggacctcaacgcatacccaggagagcatggctttatggctgcagcgtgggcgaatttgttaccgcccggtaaagtaccgctgctatttggcgccgcatccggaccagcactctggtcagccaaacaaatccaggaactcagatccaaaatcccagttggtggctctgagaaaatccaggttgaagtaccaaacaagaataaagacggttcacacttagagtatgtgacggtccataatcttgaagtcgatctcaggaagtttgtcgttcaggcattccagattgtgaatgggtcaggggttcgtatcgcaggatacgacctaccgacacagaccagtcgcgccagagttcccgacgaggtgctaacatacggtgactccagtccaagtgagaataactggtacataaatgttcacggcggtatccgctcgggttcgttactcacttctgctaacaatagcatgctaaatgatgttattaacaaggccgcccctggcgctttgaagagacttggagtcaagagtaagctcgttcaacatcgagctaaagccgtaggccttggacaggttacgcgaattgacggtgatcataaggatgatgagaacaccgcgcgaggtgacgatttcttgaacgccacgaagatgaaagtttacgtggacaacaagatgttatcaggcgctgagttcttttcgtacaaaatgtcattggcaggtcggtttgctaatgcgtccaaacaagttgagggtacaaaggaagatccactcatagagtttgcaagcgtctcttacggcctaacggctaagggtggtaacacccctgtaaagcgttcatttgagcgaaccacgaccacagaagggtcgacgggttccgatggacgtaccccttgggatatttcggaagttgaacttgatcttggcctgatcgaagatacactttcggcaaaagcgcgtctggcgcctcagcgtggtagcgcaagaccaacatccccattcgggagccctacccctggtaacagagagttcatccgctccatcgccgccatggacatccatgggctagtgtacgatttagagtcactagaccccagtgcaatacaggcaagaatagacgcggaagcccggcggtatgcaatgcagcaatcgttgaagcgtggagggaccgtgaagaactacgaacgttacgaacaggaatggaaagaagctgagatccatacaatgctttcacaatttgcccgtgagcggggtaaaacacaacacaaggctcgtaccgcagatggtgcgaaaaagtcattccttgaagctgtgagtgaagcacgaaaaggaggtaacccataccttttccaatgaccaattctgtaggaaaacctacagactgagctgaacagtaaacgggagactggcaccatgaacgtgttaacatgtgtgtcctc

SEQ ID NO: 648 - DNA, 3150 bp, Unknown
  derived from dsRNAs of unknown virus
gaattatactcttatacgcaaagaagaatttaagaagaaattctaatttgaggaatatgaaagcgggtttcagaaggaatcaagaaataagaaaggcagcagaagatcaaccacgactaacgttcgatgaacgtgaaaatcaagatcgtaaagcaaacgaatttagtgcaactttccaaagtgcatcattgcaatatgtcttaagtcttgtcacagaaaaatttggcattaacaggcttgaagatattattgcacttaatgcttatggaagggatccagatatgattaataaactcaaaacacatttaataaactatgcaacaaaagcaatactcagtatcgaacactttgcaatcttaagtgttaaatctgaaagtgacatggaagatttcacggtagcagagggcttctataaagcctatgatacacttagattcatgaatggaaacaagaaattacattatgactcaagtactattgactcattaaaatatttccttgaactgtcacgccaaaatgctaattataaattgttaattgaaaaacaattttatgaacatcatttaggaagaggaattggaaagatgttgataagaatccctcttatgtcattatgtgcacatctacttcaaaatggaaggccagaaaatgtggcgcttgaaggaatgctactcaccaagcctctggatggatttcgtcctacaacaagagtagaaaatgattgtaccatcgttgaatgtggaagtagtcacgttcgcagaataatgcatttctgcaatgggagagcgctcagaccattcagtggatcatgcgttattctatatgcacttaatgatggtaagctcattccaaggtttaaatttattaatatgggctcgataaccacaactaaagttgggatgtcgggtgtaatggataatgaatttaacgctagaacgtttagttgctcagttgctacacatgtaattgatgttagcgaattactcaagtgcacggacattggaataagtggtactgatggaacatcaaaactatttactttacatagaggtagtctacatcaaaaactgggttacatgatgagtgcgaagacgttaacagcattcatcaatgtagtaattacagtttacaaaagtgcttcagatatgatcatgaatctaggcacagatgcaatgagattatcaactacgatcggtactaggatcatgaaagtttacaataataatcttgacaaggatgctccaataaatgttactatcaatggtccagaaagtgaattactaatgaataattatctctcttcattcgcatttcggaaaaatgtgattgatgaatttgaagcatctttaaccgatcctctcattggtgaatacattaatgtaaaggagtttacgccaactacacttggcaataaactactaaattcagtaatggcttttgtgcaagcatgtgcctttgttaacaacatcaatcgtagtatcaaagattcacgggcaatgattgatctattcgttgaaacaattggattaaacaattcagcaaatttaaatgaagtttcattcgcaactgaaagaatgagtaatttatcaggtgttaacgcctggaatgttgtcatacatattcttaatatgaatagtaacactgagtcaaagattagagctcttgctagtgcaggactaggtgttggcggtggacaattagtcaattatgtaattggagcatcacgactgattggtaatccaatacaaattcgtcagaatgtagtagaagtgatgattaagccatatgttgcggtatttacttactgtttaaggaatcttgtctttaatgaaggtacattatacgatccagggtctgaagaggcacaaaacatgtattgttttatgtctgatggtgaaatggaaagtgtaatacagtacaacacccaaatgttaatcaacactaacactgcattaataagttatccattacatggtggtactcgcggtgtccattctaaaagccaaaagcagtatttagcttcatgtggtatgccatttggtgtcgatggtgcagatttacgtaattttgctgaaatctttcccgcatttacatctgttcacacacttggatcaccagataagccatttcactggaaaagtaaattttcaggtgatgatatgatgattacagatacacgtgaaaagccatactatttacgtgatgttgttgacaagcacggtaaagtgtgggcactatttaagaatacacaatatgtattagaccatttttatcagaacattgcagatggcacagaggttgcaaatgcaactgaagatgatcgcagtgaaattcagtctgcgagtagttcaatgtttaagaaatataaagctaaaacactccctgaattactttcgaagttcaataatgaagatggtctctcactgtacaatatattaatgcttacttatgtcccagcgagtgaatttgttactgaagcaagcaaggttataccagacgtaggaaagttcgctgcacttgattcaattgatttgccttccggcggaagtgtacaatcaagtgatgaaataaaatactttagctcgtcattaggtaatggcgaaccagaacgttttataattgcagtacgtggaactaagaatgctgatgatgctttacttgatgttgatcttataagaagtgttgtcgataggaatcgtacaaattacagtgagtccccaagaattaaaggtccagcaattgcttacgcaactttaaagaaggcatttccaaagtctcagattattataactgggcactcacttggtggatacattgctggaggcgtccctttacatgaaggggatgcagctatcagtttcaataagttgtcactcggaagtaaatcaggtgatcatgaaattgcacttagaacaaaaggtgatattccctcgttacccgtcaaacgcgacgctattacgtatgaaagcgaatatggaattgttacattaccaatgacttcatataaaccattcttacgagccctcaatgctcatagtctttcttcattacaaaaggttcgatttaatctttagttttcctttcaagcttgataggtacgaaaataaacagcgtatgtgtgaccccagcactgatatgagtataaagctc

SEQ ID NO: 649 - DNA, 3024 bp, Unknown
  derived from dsRNAs of unknown virus
gggtaagaaaccctggagaagataaatatgtattttgaaacaagcacaacagaattaagcataaacgtaggtagctcggacacagctgaactcaagttcactaaaccgttcggcgctataagaatgacaatggtaagtaactcaggccaaggtacagcagctaagaacaaagctcctgcactcagcgatttgagccgtatcctcgtggaaataccaacacgtggcggcctttctcgccgactaaacctatctaacactgaagtgaacatgatgccactcgtcgccgcactaggcgcgagcaacgcagacgaagcggctacagcaactagctacccgcttttcactacaggcgctaccaccgcaagccaaactctagactacagctacattgacctaccagttggtgccgccgcaggcgaagaagtccgtgtcacaatggaactttctggatccgctgctgctgccgacggaataaccttccgttttactgcaatgcaaaacgtccaaaaccgtaacctcatctttgactgtactagtcttggagccggttcccgtatcgaccacactttcaggaacgacgtaacaccgttcgctgcaattgttggttccggaaccgcagtttaccgtttcgcttcacgaacagctgctgcatactctgacttgacagaagtcaactttgatggtttgccgtcgtttacttacgacgatatgaactgtctgaacgcagagctcgataaagtcatcacttctaccgtctcgtccacagttggccgtgacgcacaaagtgtagactgtgttttccttcagacgccacctggtgttaagaagatgaacattgaagctaacacacccgcggagatccgttgggttgtcgttgcatacgcagatactagcggggtggtcgcatgatagactttaaggacccaatgtacctcatcatgtttgcaggagctttcttggctggacacgttgttcaagctaagtttgacactatctcgaagatcggaaacgtcgtcggaatggtgcctgttattggtgacaaattggaaaacttgattgacaaactggattagggggcgctataaatggtactcccaatgatggcagctggtaaagcagccgatgtcctgaagtccaacccacttatcccaatcgttctgattggtggagtaggtttcgttggatacaaggcatttcagaagttcaaccctttcaacatcgcaaaaggcgcggttagtatggtcggagacgttgcttcaagtaccgctaaaggtatttacaacgtaggcgtcaagaaaccaactcgattcgctaagaagacagctcgcaaaacctacaaagcagggaagcgtggagccaaagccgcttacaaaggcggaagaaaagtagcgaaaggcgtattcaaagtagcaggtaaagcagcaacatctaagcaagcaaagcaggtcgcgaaagcagcaggcaagacagctaagaaagcagctaagacagcgaaaaagacagcgaagaaagcgaagaaagcactcaagaaattgaagttttggtgatttaaatggtacatctgttagaaccaacaaacgtacccgggctaatggtagaagacaaagtcgaaaactcagttatcatagatgctgagcaggctccttttgccctggtccacctaccatacaagacacaagccgcagttacaatgatcccaagccaaacggtgaagtatcgtacagctaaggaactcgaccaagaagctaacatcccagacttcccgcctgcacagatgcctgtgttcgacggaactggaattcagcctattgacgtgacactcaacaacgctcgtaagaacgtaacaacctcacatttcaatgttgaaggttggtgtggtgacatgagaaatggagttttcacgccttacaaggtagcttggacatacgattcagtcggtggtttaaccggcgactcggacgcgaagatcaacgctgtcctaatcgtagcgaacgacaagaccaaattccgtttgggctggaccgcaaggggggataactattgaaggagatcaacacgaaggaaccgaaagatccaatgctattaatagcgcagtttggacggtacttgccggttgttgcttctattttggtaggtttattccaagcggtcaatgcgttaaagagatcggaatcgcagtcgacgcctgtatccctagaggagactccacctggacaaccaaacttggaggagcagcttgggggattatcagtaatattccagcaagcacatcttcagttagtgaagttgacgaagtggaatatgatggtgatgatgatgatgatcatgacgactttgagcacagtgactattcagctggtgaggtggtaacgtatgagtaaagatgaagaggagaaaacgccagatattgaggtagaaatcaccaacggtaaaacgattaagatcgattttagtgccgtggaatgggtgatcatcatgtctggagtatctctgatcgctatgataactggggtggcactgtgaaggttccctttccgtttgaagacttcctgtttaacccaggtaagagcggtattgacttacacagccactacggtcgtacacttggtgggtcggttgacctctcttggactatcggtcgtacacttgacctttggattgctcctcacatggtgagtgaaaaacgcgaagcgttcgacatcgcagagtgggcagtccgaaaggaatctcaagcaccgagtttggtactatcagctattattaacttgctagacgcaggtttattccgttacgtctatccgaaaatgggacgtatgatgtatgaagaccctaaattctacgcagctgtcatagcggcgaagggtattgtcaattcaacaatcgtttggaagaactgggacattcttaaagagaatgactcggaacctgaatctatctacaacgcttagtttgttcaaaacttagttagatccctggaggatctgtaaataacattaccgattaaaggtaattaagcttccaccc

SEQ ID NO: 650 - DNA, 3021 bp, Unknown
  derived from dsRNAs of unknown virus
actggactcagagaccctgtttcagcgcgtgctatcacgcatcacacaatgccactcagcaagaccgaagcacaagatgctatcatcaacgaactcaagcaagacccggagcttgcattcctcaaatccgccgacaaagatgcaatctacaagatgctcggacataagtctgtccggcctaagtatgaggcaatcaaagccaagatcaacgccaagaacgtcattcctgacgtcctcaaggactctggcgtcacagccgagatgtgggcctacgtcaattccgtgcgcgacattcgcaataacgcccgcgcagctcacgcaaataggggcaaagccctggccgaccagtatgccgctgccgtacgccagaacgacgccgaacttgaggacgagcttgccgcctcagactctccaattgttagcatcattgaagccggcgtcgacaaccttcctgccgccgaagtcttcaagctcaacgccatcacagacaagaaagccaaagcagccgaagaggccaagatgctcggcaagttccgcaagctcgcaatcgacaaggtctatggatccgccggattcgacgcaagcaccgaggcgtcccgcagcgcgtaggggctcggcaagctcagggggaatggaaccaccctcctgggcggtgccgttgccccctttgagctggttgctggcatgcgtcgcatgcgtggactttgggacaaacaccgaaccgaattcctcgaacagcactggttgccaaaccccgtcttcgaagcacgctcacaattccgaaacatcttggtgggatggctacgtcaatttgacgagctatatcccggtaacatcctcagctccgccttctcccccaccgacgaacgatgggtacgagatgaaatcgtcgagcacacactcacagtgtgggcccagcgagcggaatacacgaacactcttaacatgcgaccaatcgagttcctccagcgacgactgctaccagaagcatacagacaaatccgtgatcaattccttgaaggtaagctgtccgagccattcaccaatgccatccgtctacgcgtatatcacaacgaattccgacgccgacgcggacgcatccctaagtacgccacttatcaccacctcgaggctgacttcctcaccggcaccccagccactaccgtgcgcaccgacgaccctaatgatgcagaggccgctgcaagactacgcagcctcgacccacgatggtcctacactcagaaagccaaatccgacgcctgcctcgcccccatcgcccccaaccctgggctctggcttgaaggacgagtcaacatcgctcacggacaaaaaccttcaagagtttctgacacgtcgaacatcgttggcgaccacatgcgcgaagaactgccccaccacgagcagctcgatccccgccgggtcattgtattccctggcagtgaaacgctcctcgcagaccttgaaaccaccgcaggcaactaccccacgtttggaggaacccgcgaagacatcgaccttgccgttaagcaaggaggagcaagaggccttaaattccgccatatcctctctgctgaaacctgggagaacccgggagcagtcctcgtcaaccccaaggcctcgtctggatttgatttacaaggcgtcggagccaaccgtcgcggatcagccctccacactcaacgactggcggagcgcgtggtaaaagcgaccaaagcttcccccatagcttcctgtggtgtgtggcaacttggaggacgcgctaagcgcaagacccccgaacttgggtcaaagcttgctgcgcgggccatcgtatatgacaactcgatctctgctacggtctcttcgaccatatcgcaacccttctcgacaatggtgaagtcggtgaagggggacattcaaattgggcacaccgatgtacgtggtggcgccgctcgagaccggagggtgtccgagcagcacctctacgagacggaaattgaccacaaaagattcggatttcgtctgtctgaaccgctcctcgtgagcgcgttcggcataatccgtgcctgccttcccactggtgaggaatgggataaccggattctccacgagatgagcaaagtaatcctgaaattcctaattctcccggggggctgggtgtaccggtggacctttggcaacccgtcaggaccctggacatcccttctagactctatctgcaactggctggcctgcagcagcgccctcgcgcagctcaaagtgcctccgtggcagcgcacgctttggatttacggagatgatactctaattgggtggaaatgcggatccagcgcgcgtgttgcttctgagatacaagacatcctgttgaataagttcggcatcctcgcgggggatagccaggacggtaaactctcccgttataacaccggcgagcctggggtgactttcttatcctcctggcacgaaggtgggagatttgggaggcctttgaataaatggcttgatgtttccgccctacctgagaagccgaattttgtgccgggtgcgcagttccgacgctgcgcctacctttcacacgccgcatggctgaccccagacaataccaaatactttaacaattatttccactggatcaacaataagatcaatccagtttggagactaccttccactgcagtggacaaaatctgcgagcactcgtggagcaccgctgcttatgctttcgcctctggtggagacgacacgcgaacgtgggaacgtggaggcaatacgcgccttaatacgattcctagtccgaagcgtgcacccattaattggggagctcgcccgctcgctgacttatccacctcccttaccctatcctggttataccggggcaacagggacgaaggggacccgtccatccttggcttccgccaagagaacctagacagtagcatcctcgacctactccgtgataggtctgattacatctaccgtcttcgctaatccgctggtatcacgcaccagtaggaggcacaacagccgtggctcgccacatcc

SEQ ID NO: 651 - DNA, 2790 bp, Unknown
  derived from dsRNAs of unknown virus
gaattaaaatacaaacagagtcacaccgttaaattgaaaccttcagtgtttaaataaggtaacgaaagcgcgatacgaatattcgtagctattattatcagttcaaactatataattatttaattattagttgaacattgaaagttttgaagtaatgagtgaagaagggaaaagatgtttaataccaattgaagacataaatgtagtacgggctgtcgatgcagtactgattccgacattccttgatgtgaaaattgacatcacaaaagtagtaagaaatggtggtgttgaacgttgtaatgaggattatgcattacaaattgttaacacatctgacattcctacgattgaaatgctaggcactcaatttacaagattaacaccaataagaaaagattcaattacaagacgaaatggcattttatcaaatgaaacaggaaaaattgaaacatacactaattcttggcccaagtatggatcagctgtgcactttatacctaaaacaggaaggtactttcatctattagaaaagggtgaaattgcgtgtttttggactaagaatgtcacaggtaaacttcatgataggcaataccatgcatttgaaacaatgcaggagcagttaagatctgactatccacatctcgtccggagatttaaaatggtcgcacttcaagagctacccgaatggacagaacttaaggcgtcacctagtgaactaactgaaacaatgtacttttcagcattgcttaaattgttgcatgatttcattgatcagaatagagatgtacgttctatacatttgtggatacaaggtgaagcaacatttaaagtaatgagagtaatggacacaaagggattagctaataaatatggtaagaatcaaagtgaattgtcagaattctttcataaggaagccatgactgtaattgagcaaggtacctctttatctaacccaattaatacgttcctgaaacctttcaagttcgcaaacagaattatggatggtgatgttcttcttcgacgtgattatgaattcattgaatttatatatgctttagctgttaaggatgtcacgcaacctgaaattaatttggattcacattggtgggattttaaagaattgaaatatacaacacaaatgttcaaaacttttaaaaatgaagcaaacgcacgatcataccacacttatgtagtagaaatgatgaaggactggaatgagagatttgaagatgacgcacttgatcacaaagatgatttcacacttgaagtaattgatatagattattttctagccatgtcattcttttcacgttacactaaacatcgtgatattacggataattcagtagtattctggaactgcagttcaaaaaccgctacttggttgcaaaactgtggtttaaaaattggttgtgtggtcataatagatgatgaaacgcatagatacaacatgtatgagcgatcaaaagataacaccaaacaacctgctgctgaaagtgcaagaacacaaaatatcatggatctacttatctggtcgagaaatcaacgtgatcatgagacaggcgaaattcttccatcaataaagaatgtctctaatttctatgattcacttgaatttgcggaaaagtttggtccaatagtattaagtccttctgcttcaggtaaatctgagttcgtaaaaacaatgagaatgacaaattccttggaataccaccgccatcatgaaaatttggaaaaaacgagttggatggcatatcacaatgatgttactaagacaccaagtctctcaacatttagaatgaacttacagaacaggtcgagaagcaacaaaccaatgggactttatgaaacagcgttcagtacaacagcgatccttagatcaatgttcatatctccaagagatttacttttaagattcgaactttctgacatcaaagattttgatggttcagataatacatttggacttggtgttgttgaagcgattgaacctgcaacatcaattgttgatggtctacgtaaaaaactcatgggtgaagatcaaacgttacttaacacaattgaaagtgcattatcaatgattttcacattacgacagtatacgccactgcatacatcttcaaatgtcttccttgtacccataacacttggcgaaatcattgtaaattacactggtgattgggtgtatgcatttgattttacgtatggtttcagagccgtatctgtaacaagatcaaatgttagaagagagggaaatgataatgcaaaagcagtgtttagagatattgaaagcctacttaagcgtgtcagcaatgcatatgagcttttctctagatttgcacacgttgatcatacatcaacacttttcttctatgccaagcataagattcccactcctggaagtgcaggtctcactgcaatgtcatttcgtactatgtttagatatggtcgcaacattaatgcctataaacttcacaaaaaacttcaaactttaaatgcctcgggccatgcaatggcagcattgctaatgccgaggtgtattttcctaacttaccttagcgaaattttattcttaaacgcaagctcacccttctcattccccacgaatgagcccgtgcgggaagggagttttcacactaaagatgaatatttagcggcaattagattcgcttcacatgcgtactcattaaatggttcagccggtcgatacttagaaatcaggctaacactatttagagcgatatgtgaagttatttagtgactccggaaatgaatgtattttaaaagctc

SEQ ID NO: 652 - DNA, 2773 bp, Unknown
  derived from dsRNAs of unknown virus
gaataaaccaagcctcatagtcattcaatagtacagtaagcgacgaatttctggcgaagtttaacgatgtcgaaaaccgtgaccgttgtgcggagccctgatcagcaagagaaggaacagatcgctcagccgatagagttgacgcaggacgaagaatatattaagatacagaaagccattgccgaaataacctatagtagtgagggtgacctgcaggagggtaagtccccgatggagggtctcttctttgaaaagttacgggaacacatcgacgtgaatgttggcggtgagagactctacaatagcctggtgaaggtaaggagacatgtggaaaattcaaccccatggcttcgagaccgcatcggtgatcgtgatctagccctgacgttctcaaaagatctgatccccatcaccgatagtgggccaggagggagggagtccaccgtgcattccgcacagatgagtacaatcctggagctgcaaacgtttggccgagagaaggcgcgcgagtacgccgaaaagaacttgtacttctcagatggtgaatttggaacgtataccgagtccagaggtaggcagtatctctctcgagtgtcaacgcatgcggggatcaaggacgagtataaagagtatgcatccaaagcgatcactggtctgtatacgtatccgggagcaagcgtggttggacgtgacaaggagtacacagaggttacaattctggtaaatcatcatgacagcacccctgctcctcacaagctatacgtatcaggcaggaagatggaactaatcctaagagatctctctaatgcgtataccgtgtacaatgatacaataggtccgtccttcccgcgatctctgacagttgggtataatgttgtgagtggcattatatcggccgaaagccttcacgtcaacaagcgtctccgcgattacgggacagaagtaacgccgtcagccttgaaggaagcacttgaaagtgatggaactctccaaatttcctcaggccgagcagttgtttctgaacaggaatacgtgaacgaaaagatcgaggtattaaacgggtggaaagggtgccgtcgcctggtatgtaaggtaacggcgaaagtgcaagccaggcgtctgtctagcgcaccttcggtacagaggatgccagcggtaggtgagattgaagttgggttcattgtcgtggtaatggaaacacagcctcagacagcgggtggtcctatcattggtgaagtggtcttcctaataacggtaattcctaacgagacaatgggtatgccgtatgttgtgacgaccggtgtatcccagagtccatacggaccgccaattgcaggaataaactttcctgtagtaacaatcgttccgaacgccggtgacgaaatcagcataacgcagaagatgcaacaggaggtaaatgatacaattacactgggggatggtttcgtcggaatctcaggtgtctatcgtgaaaaggatcaggtgcccaacaccatgaaggggatcgagatgcatgatgtatccctgttaccggacgatgttaaaatgatcctctatcaggtaatgctgaagcttatacatataaaaacattccgcggagtcatatcacacacaggagatacgtgggatcaaattataactgctagagaagggtatgtcgcaccagcggcaattgaggagttcctggccaaaaatcgtattccaatgataggcgcagggggctccgtctggcacccgcattacgagcacgggaatatgcgtcgttacgatgttcaagatctactcgcttactgggctatgagctatctgttcaatgtcacaatcagaggaatgaagggaaagatcatgcacacaatgaactactggcgggcgaccaccgcagcacttccaccatgtgtgtttccaacgcgaactatagcttggaacatctcagcatcactcctaatgaatgcacttgaatgtggcaagagatctggtgttaaaagcacactgactgaaaagcgggggaagatgtctaatttgcataaggaccgtgttgttggatttgcccacaccgaattctccaacgaccccaggagcactataatcacagccccactgagggaagatgatccggtgaaaggtcgcccatatgtgtgcgacacatccggcaatctccatgcccatgagcttcagattgcagagtgctgtgtgcagctcgaaaggagctcaaggaccgtagttgtcgaatggaacccactcgaaacacgtaatgtggatacggaaatgttcggagccgaaatagcaaaaacactcaagcgcttcggcgatatagatcacggggaaatcgttgaggaggggaaaatgatcgtagagtatgcgcgttcaacagcggccgaaagatgccatgcatccatcacaaagttcgcagataaaatcaggttgcacacgtccaataaccagtctggtgagatggcgatatacacaccgcgatatatggtggtggtctcgtattataagggaaaagcaacagcctatcttcattcaggaccgcgcccgtcacgtatagccccatcgttccacgatagaaaagctgtctctcgcctagagcatactgcacagatggtgcactatgcgtctattggcaggtctggtgcattaggatacatcaaaggcttcattgataactttgatacaatcatggaaaatctccttgagggagacgagtaaccaatgatgcattatgacgatagctctgaagacagaatgaggaccgcacttggtagaatacatc

SEQ ID NO: 653 - DNA, 2625 bp, Unknown
  derived from dsRNAs of unknown virus
gaatattaactctaccgaactacaaccaaaaacttgttttaataaagacaagttgggggataaaggatttaaagtggagataaacaatacatttaaaatgttaggacagcatttaaatgtatcaggtgttacacagacactaacggagaaagcgccacctggacttgtcaatgtacaggccagacaaattgaagttaagcaagatgtcacacgtggtgtgctacgtctacttcataatcttagttcaaggttgatattcgccagaaatgtacgtgctatgctaagtactcaaagtagtaagtcaaagagaatgaaagcgatacttgaacaaatacgttcatatccatcaagtaataatgctgcaaacttacaaacttatgtacgtgatataacaggtctcgaagatccaggcgcatacctggtcgaacaaagtaaaaattatcatgtatcaaaagtggagacagccgaagcatatgaagtgaaaaaggaatgtttgagggaaaccaataatggttcgattgaaacgctctcattcacgggtgagcattcaatggtaccagtattggtaagattgaatgatgatcttaaaacatatactacgcttgatacacctatgagtgattatacagataaaagagaaatatttgtaaagtttgctgacgttggatcaggaatggaaggtggtataattataaatggtaatgtgacaatgaataaacaagtagatggatatgattttacaacattaactaatgttcgtggtgtaacaccaaaggtccaaatgaacctgcttgccactgttaaaaaggaacatataactatgaaagagcacattactgaacgaattactgaatttgggttaagtgaagtttttattagaaatcaactaattgaaaagctaggagacgaagctagagaatggcaatttgaagatgtgtgtacgttaacctcacgtgataagactttcataaacttcacgtgtaatcaagttgttctttcttatgatcaagaggtaccaggcaatacatatggttcagttacaaagaataaggcgattagacttattctgaaattttccggtattattattggaaatagatcaaagatcacgagggtaactgtggatgaagatcttaagtcatatgttgaatcagagaagaaggctggtaatatattcataattacgtcaattgttgaacgtacaggaacaaacgatggtcaaccctttccatcagggtttccaaaaagacgtggtcaagatggtgaagattcaattacacgacaatccatgtcagtacatggtggtgaaaatgaggaaagtgatttagctatgactgaaatgcttaatgaaatgattgaaaagacagataataggcatttgcgcattgatgaaagagataggaccttaatagcaatgttagtagatcagggcgttgacagatcaaaacttccatcaacgcacattgacctttatagctattataaaccagagggaatgagcggtgtgaatgatcaaaagacgttaaacataaactcaggttacttagtctcattcaagcatctcgaagcgtttaaatcatcgcatggttattcgcgtgatgtgagtgaattccttgatgaacttacatacgcatttcttcagcaatttcgtttaactaacgatgagcttgatgatgcaatcaatgaccttttcttcaatacatgctcagttggagaacatgaacatatgagcgtgtgtgttgattcagaagcagcaaaactcttcacggctaaacctggcgtaagtcatgtaacaccacttgaatgtcttcaaagaatcctattatccgccatcttgtacgttgaaacacaatcatcatcaagtgaggttattggaccaacgcttatgcttacaagtatgacttatacacgtgtcatggcaacaatgctaagtacaagtcaaatacttcatacatataatgaagaagtagatgactttgttcaagagaatcgttctgttgtggtggcacatacaccttcgccttcatactgggcattattcaagaatacaaatattggttctattgctggatatgatcgtgcgcgatcagaaatgaagcagggtaaaggtgaaatcaggctattgaagggtggattgatatctgaaccacgtgcatacgcgagcgtatcaacaggtctggtaccagttgcacaaaacctaaaaagcatgtatgtcaagttgaggattggaactgtaagctacagttgcgattttctaatcagtgatcttgtcagagcaatcactgaagcattaaacaatgatccagatgaagcaaatgcaccaagaacattcatatatagttgtgcagttattgcattattaatatgtatgccagacgacataactgactatgataagaagccacaggtattcgtgattccatcaccaagaccaacacgttatgtaaagcctcttaagaacataagtgactcatacctcatgaatgatgataagaccgttaaagcatatcagcagatatttagaaaatataactactacactagtaatgtagtagcatcaaagtctgcattgaagcttaaggatttttaaaacgttgtagttcatgtcgcatgggttaaaagctc

SEQ ID NO: 654 - DNA, 2637 bp, Unknown
  derived from dsRNAs of unknown virus
agtgcttacggatcaatgatccgagagcggaaatataaccagtggttatagttcactagcgctaactaggttagcacctgagtaggaaaggtttccagacatacattggtatgtgaccgaaatcacagctcaaataaataataatatttaaatgataaataataattatactaaacaatgtttaacatattcattatgcactataagttcggtttcttccagacagtttggttctaatccgagtggtaaccgtaaggttacttcgaataagaagaaaacagtttccccgcgcaaaagcggcggttctaaagttgttttcaaaaacagagggatcattaatcataatttaggattaatggctccaatatttaacccgttaactcagcattctgagtcggaaattaaatattacttcacaaagatggtagaagcacataacaccatgatcaaggatctgggcgtggtctacggtactaaacattacaaagcaatttgccagtattgtttacttctttgtgagggacacagtccacaacctgtggatcgagtgtctaccggtaaggttgataaatggcccaaagtttttgggtttttgagacctgtctatcattctattgtacctaccctaagtggtaaggtacatgaacctagtacaagagttgagaatctcagactcttgaagactttattcaatgtgaataaagtctgctcggattactctggaatcgatgttagcaacttgcaacaaagatttgaaattcctcgtgaatgggaagattcctttaaggaatacttactaaacacgatgggagaacctaaacctttagaaactaatagtttcagggttcaaggtttccttgggaatagaaaggggcctaacggcgtatcgaagattgaatcagcaggtatggaagcagccaagctactatcatcaccgctacacaagcattttaaaacgctttgtgtcattactgataatcttcccttttatgaatattttctgcaacatgcagagaaattcaccactgattatccaaagtatgaccttaataaggtcattctgagaaaattagtggcagttcctgataaaggtaataagtctagaacagtcgcaatttgcgatgtctggactcaaatgctaatggagccgtttgaaaacgtgctcaaacacaagatgaatcatgagtttcatgataaatctgcgtacttcgaccatgccgagggattcactaaagtgaataacctcgagcgtagagacgatacaatatcgatcgacgctgagcagtggacggataacttcccatctcgtgttcaatacctggtagtgaaccaacgatttggtcaacaatttgcggtagcttggcaaggcctagctattacgtgtcattggaatgtcggaaattccgacgagaagattaagtacgggaaaggacaaggcatgggaaccaagggttccttcatggcagcgtcatattctgatcaccatgtgatagaatatacctacaaaacacattacgggcaaacattgccgtatatgaaagtaggagacgacttagttgtaacagatccgaacaacgtgttcgtagaaatgtataacaaactgggtgtccctgtgaacttagcaaaaactaaaggattggcccctaacggtcatttcttagagtttgtttcaagaaatagttggaatggagacgattactcgcctatttcacctaatcttgtagcaaaatccttaaaacagcctttctatattccaactttagttggacatttgaaagaacggttaccaaatcagaaagttcccactctagaagcaatcctggattgctcacaagagtatgcgaattcaaaggaaaagttcgaagcacataaagtgtcgacaattcaactaatgaaaacgtataacgaactatctcacaccaatatcattgatattgaaagtgaggtggaggttcctaatttagataagctacgcttatctattattaaggaaatcctccaactctctactagcagggtaaacctgatgtctagtggagatgatgctgatatggctatggaacatttccaaacattcatcaatgatgaatatgaggataaatggttatattttattgatcagaaattttctctaaaagagatagaacttttcaactattacgaccagttccaccgtatgtcaaaagggattagtgaagaagcaatgagcgaaggccatatttatggagatttcgtcgctgctgataatcacggacctatggaagaatcctacggtctgcatcctccgtattatgcaagtgatggaattatcctatcttgcctaatggaggcgaagtgtaagcttgagggggtcaaaatcatttatgatttgagctcgtcatctccgaagaattctcgacctatggtcgaaatgttcaagagcttcaaacaatgtttgaagaactctatggacgatgaatttaaaacggatatctcttctaaagagaagtacgctttatctacactagggcttaacaggttgtataaatcgatccaggatcggctccaaccttgtaaagatacagtatagacaataccgccaaacaagacagcacagtctataaaagcagtcattgagagcattgctctcaacgcact

SEQ ID NO: 655 - DNA, 2618 bp, Unknown
  derived from dsRNAs of unknown virus
gaatgaagaatgctagaaaacacaaataatatacaaagataacggagttttaaagtagaatcaggttggtgaagcttcctagtcccttattgggatctcggaatgagtgaaattgttccctatcaggaagtaataactgaagaggaggcaaataataagctaaagcaagagttagagggccaattacgtacgttacgtacgagaagtcctgatgatcgttttcgcgcagcgatatttgaactctttgtaacgtttgatgacatatcctttaatgaatcaggtatcgcggaatcgataaacgaagcatggttagactctaacttgagcaatactccattcgatgatagatttttagacttgctttccaatggacagctatttagagatagtctcggagacaggctcggcagtagagtagcgaccttatgtattgacttagtgtcaggtaaagtactagctaccgacataaaacagcgtgagctacgcaaacttctccaattgcagttgcgtgcgatggaaaacattggcgacttgaggcgcaataagcgtttacgcgagcaaggaggggtaaatgataaaggtcaatttcaatacctaaatctaaagggcgcacgcatgccacgtacgataactccatcagaggctaatattatgactagttacgagcaaaacgatgagtatatcatacatactaattttagtaggtatgcacgtagtgaaagattgaggacctttaatgaatcagagggtgaggtcggctcatactcgcattccgctgaaaatgctcgagatatcaccacaccgaaaatcataaaagtgaagattgataaaaagtacactaacccataccgtcacgctattcctaaaaagtctcacaccgcaacaaggttgacggattatggttatggagctactacagaagtacactttctggatgacgtaatgcttgctgaaatatctggcgggcgttcagtccccaaaattgataaggagcagcgagaaccgaaagacggaacctatactttacagcttaggataccgtcgacacagatcaaatacgtcatgacgagcaacggaattgggagcgaaaatactaccggaccaattctaacctcaacaatagtgttaagtgcgtacgtaaccccaaagataggaaaggaaaagtgcagcttaattaagttcgtgactcatggaaacgaaactttacttttgaaggacatttttgtcatgaccgtaattcctacaatgactcttaaccctcgccatgaattaatatcgactagtttccctgtcgctgcacactttaacgatgtgggtgacaatttaagcgtgtcgatgctagagtcaagctccgactcaagaaacatagctgacattcagaggtcatttaatgcggaattacgtgaaacagaacagtggtcaaatataaaatacgcagagctgttaagcatgtgtaatttagtgtcaaaaagaaaccacaaagggctggggaagactttacaagataaaataagatcatccaagtttataatggtaactgaaaatggtgttgagtttgaagatgtggaggaaatccacgataaagaaccagtactattcaacatgctacatgattttggcctaagactcttgtggtatacaagtacacgtggtgtatctaatgactacaagatagtttttgaggaagtgcctgacatgtgggagagatttttccaaacctcatgcggtccaagcatcactcattctgagaacattcgatcacccaatgaggaacacaccggagcgaaaaccattacacctgaaatacttttagttagactcgcgttatcacgtatattaaatgttggaattggtgttaggaacgagcacataccgacacggccaattgcacgcactgtcccatttcatataacaaaccaaaagagggccaatttaacgagtatcccactatgtgtactaaaggatgaactgctggtatataatctgaccggtacgttaggaaagctttttgatggagttttgccaactgatttctgttataaagatcgtaacggcagaatgagcgagtgtagagatttgaaaacaatagtttcgatgtcacaaggtcagcgaaacgtaagatctccacaaatggcacttgatgcagctcacgtgctcttcacagtaacctcacctctaatacaattaggtgtaaatgatgatcgcgccacggtgaacccgttacgggtgatctcaccatcaggtgatgaattcgatgtcagcctaattgcagaagagatatgcagaaagctaatgtccaatgctaaaatgcggggggaaattacgaagaacgaaacagccataatgtggcatccacttttctgtatcgtcgtcaacgtaacgaagattagcactgggagactcatatgcgatgctttgataatgccatcaaaacgtgcgtcgtcattgtctacttcatatcataacacaaatgacgttttgagagaaatggagttcaaccatgacgtacgtgtccatttcgcaatgctctctgataacttaggttacgcaactgggctaaattcccacctccaacgcaactatgtataatttctggagccacacattctcgaaacatc

SEQ ID NO: 656 - DNA, 2376 bp, Unknown
  derived from dsRNAs of unknown virus
ggagaatgagctactagtgtgatcttaacaacaacctagtcgtggtcagcgcatcacgtccaaggcgccccttctcaaaatttagccgattctcaaaggtaagttcgctccatgtggtgtttagttatgactgtattaaagaatttaagcaaagtagtgcctgtgaacgaactcagtaagatgaccaagttagccgacttgaaaccttacttacctctcaacgtcgctggcgttacgatacgtttagacgaatcgagcaggggagcggcggccgttggccgtcaaggtggattcctccatctatccaacaccccggctattcaggagcttatccaagaatacgacccccgggacatagctaaactaattgaagaacgcatcgaccttaattacgaccccgaactgcgagagttcgaaggttcgattgaggagaacatcctcgccggtcgcggtctcaggaacccattccacttgctggaacaggccttggtatcgggacccaccggcgatgatatgaaaggagaccctacgccgtataacgcgggtcttctcgacgaagcggtggatgatctaatagacatcctccgtcagcggctgggcaggcagacacttacgccaaagttcgccataccctgcactcctgcttcggtaaagcaaggattgagagttgcccacattttggacaactcagcagctgagcctttcttcagtgatccaggggtcaagtccaccaagaagcgggcccatctcaggcccgcgttcgagatggcgtccaagtttgcagcacctacggatcggctgcccttgtggcctgcggttgccttcgctagaggcgaccgtaccacaagcgattttgacttgatgcgcgataacccggaagcgagatcccgggtcgtccacgaaatgaaggaccgcttgattagcggtcaatctttcgtgctccagattcttgatggcatgttcactcaaaccctgagtgaagagattgcttcggctaacgttcctgagatcgacatccgtgagccatggttactcgcggactggttcgaacaaggcaggaacatagttacgtcctatcccaaggctaagtcaattgggacggatgaatcggcgtgggatcaacatttcacgccgcagctttggtatgcggtattccgaatctacaaagccctctttcctgagaccgtcgagatcgtcttcggcttctcagattaccctgtagtcctgggtgaaggtgacatttctaaactacaaggtatttcagcggaagaggctgccacttttgatatgactgttcagattggagaagatcaggccattaagcctgtcgacttcatgaagttacgcgttaagactgaggatctcctcaggcgtgtcttcgctggcgcatccggaacgagctttcgtttcggtgacatcatagtggatggattcaaatatgttattgatacagagaaagacggcccagtgcagctgggatggtccatgcggtctggtaactggatgaccttcttggctaacagtctagggaactggatcaagtttatctatattgccaaagcgtcacgcaacgaagcattgcgtgaaacctactttaggaagttcggcgtcatgccaccacgcatcaagctacgatggcttgtagtccgtggagatgacgcaggacaagtctgggaatatgtcgaccaagacgacgacagctccatcgctgaagcgatggccaactggttcatcttgctgggtggcagtgcgaacgctaagaaacaggaaacatctgatgaattcggaagatggatgctgggctttgcacaactattcacaagtgagaattacccccggggtgtttcgagtggattgcgtactttggcgcgtgtcatttggaacgagcgagacgaagtcgtcctagacgacccagacacaggcgaagatatgaggccgtatctacgtctgatgaatatggtaggccggatgagtaacatctggggcctgtggaaccgtgctgagcatcctcgtgctcaagaaattacagcattggtccaagatatggattatcgtgaccgtatccttccaccactgaccgataaagaacgagagttggcagggagagccttcgcactacgtctttatagaaggggtcaaatcacgaacccggccagcattgatgaagccatccgaagtttttggacaactgatttagcacagttcgttcaacggcgtttcgatgctgaaactcgactagcaggcgagtttactccgctaccacgtacacctaatgcacgtgacgtgtggcggcagtgagatccttcagggatcactgttaaccaaaggggctcatcggccagcacactgtggcgagtgtgctggtacgccccacct

SEQ ID NO: 657 - DNA, 2500 bp, Unknown
  derived from dsRNAs of unknown virus
gaaaaagaaggtgataaagaagtatacaactactttttcgagcgaatcggtccttaagggattagtgcgcatttattgaaagggtgtgagcagcgctagcctcccaaaaattcgaaacatgcctacagctacgtcttcaacgagtgagactgatgattttcatgatataggtcgtgcggggaccttttatgacgaagcagcgcagcctagtgttgcagagacttcaccaggactcggcaggggcgcaaggccgccaaatggcgtggattactacactcagtacggtatattatctcccaaaagagtgcgagagatcgtgacggaaatgttgaaagagagcaatggacgcaacatgaaagcagaagttgagaccttggggacagattgtatgacccttcagagtgtgtttgaagggaggatgcaagtcaccgagagttcggttaaaaatgcgtcagcgtccatggttaggatgttaaaatacggggagttgatgggcaaggtgacgggcctaaaagacctcaaattaacggtaataagactaggcgttccatgcgcgctcttgattccaaatgatgaacttgggacatcatcaggcaggactggcagacctcggatggtatctgatgaagcgcgagctgaggctttttcttattttaataggataattgacacagggccggacaaagtgttgggaatcctcgcggacacgccttcgcaaataataaaactgctaccagaagcggcgatacctcagctccggtacaacatatcgaaggaaagagcgagggcatcttacgtagtttttaatgtcgaggggagggacatgtactcgacagtaccccgagtgtataggtggtgcactcacagggatgtggtcgtgtatagtgccttcgaggcctgcagagatgctaatgattgcttaccgggaccggacgatgaagccgtgacctacactaaattgtgtgatcaggtgggggacaaactgcacgtattcgacgtcacgattaacaagatagctctggctaaagtcgaggccgccttgttggacgagcctaatgatttcaatttagaatctgatcagatcaagcacactaggccggatcagtggtcaagagtttccgcaaaggcaaaagcttactcgcatgcacttaaacaattttgcaaagaagcatctatgaagcagttggagagcatgagcaactttcctgatagttacaagaacgagaccctaacggatacgccttacctaccgggaatcggtagattcgtcactctgaaagaagtcgacgacaagataaacaacggcctagcagaggaagtcaaaaagaacattagagagtttttcgaatctaggaatttcaaaccggtgttcagtcaaaacttgagagtcatgtccatgcttggaactataacattcaacctcactatcgtctcctgcgagttggatatgataggctatgttctggggtcttttgcctattacgaagagagcgtggtaatgggaaaaatcttgatatgtgccatgccggtggcttatatagggtgcatcctgataaggctgtctggaatgataagcaggggggcctttgcaggaatggaaagtgatgtcctatcatggtaccatgtagtgcctatggcgcgatacgtcttgttcttcaaaccaggtggtgctggcgaaaatgacgttttgcaattatttagagttaacaccttgagctccttcaccttgggcatcgccatgctagtctgcacggtgctacattatgcaggagggggtgatacaaacgtctacaccgcggttagtttgactgcgcaggtaactagttggttggtcaccgtgctgtacttcaccccggttgctaaattcatgaaagtgcttacccaggttgatcaagacatacgtgtgacgacagctcaaggcagagaaattcttgatcttgagcaaaaatcgccgcaggaaggtgagaagtggaaggatgaaatgtacaacaagatagctagtctcttgaacgtcccgagggtgcagatcatcgatctgttgccaaggtacagtgactattccaatttctcttacatgcacaactgtgctttgacctcaagggcagaatacaaaataaacgtaatgttagggaagcgtaattcttaggacccaatgccgatgtggttgaggattacaatgggtgatagtagagtggacttgggtcggcgggaactagtaaattaggttcataggattaggatatcagtctttaacaagttgggggcaatttattctaggaggggtagcaaggttcccattcctcgaacgtgggcagctcagcggggcttacagctggactgcgctcgaccagaaacacatgctgaggccgtaccaatcggggcagccacttgaaggatgtgcgggccggtcgatctaagcgcaggttattcgagacagttatcgacttcgggggcagaggtcgcttttctgctctcgtgcgcgattttatatatttttttt

SEQ ID NO: 658 - DNA, 2453 bp, Unknown
  derived from dsRNAs of unknown virus
gggcttgtccggtgtgctacaccggcaatgaaggcatacttgataaaagtagcaagacatgtgtcactgtatctcatcgtgacaagtccaatagccttaccaaaatattgaaaatgaacaacgttaaccaacatagattaattaatagaactcggaagtttgttaaaactaacgaggcactaataattaaacttagtagattatcattgaatccatcttcacaataccttggtgagggtcccggtatatatatatacacagcaaagtttatcaaactttactcccataatgggttggcttacacacttaaatattttaagaatgcaaggcaagctgtatataaatatactagtggcgactcgatcaattctatagatcatgtctcactaacaaaagatggaattccagtcttcttacaagattggattcctttattaagatccggagaccggactgcaatacaagtagtattgagcatcctaagtataggaaggctgtttactagtgtaggtagtctagaaaccgagacgataacaaatccatatactggaaaagaaacaacatatgttatttccgaccaggatatagagtcttttgtcagtgagtataatctgagaattgatgagatcgaaagtcctgagttttatttgagatcctcaactggtccaacaggaccagctatggcttctatttgtcaagagggattaaacttgccagaatggttatataccattctgacaagaatattacctcaaaatcaaataaaagttttagatcaaataagaagtgatcctacaattaacactccagatcttcaagaactatgtaaagattctaatattattagaaaaattactgttgttgcagataaggagggtaagaatagggtcattgcgattcttgattattggtcacaacttgcactaaagcctctacataagaaccttatggatcttttgaagaactttagtcaagatgcaacctatgatcaagatggaatagtaagtagactccgtaaggaggacacttattattccctcgatttaagttcagccactgatagacttcccctagtattgcagggaagattattaaaagctattcttaaagacgaatcgaaggctaatgattatatatcactcctagtggatgaaccatttactacacgagataacgaagttatcaagtatagtgttggtcaaccaatgggagcttatggatcatgagcccttcttgcactaactcatcacttaatagtatataagagtttgatagaatcatcaaccaaattggatggtggggcttcaaacaattacatactactaggtgatgacctagtgatttcaggacaatcggcttcaaatgcgtataaacgcatagttcaagatctaggaatggaaataaatcttacaaaaacattggaaagtaaaacttcctttgaatttgcaaagagatactacatttctggagttgaacactctccgatgccaattggtcagataaaacatgcaacaactcagtattgagatattgtaggttttatagatcaatgtcaagggagaggatgaagtttctccgctctcagtgctagagaaacactgtgttcaatcatctttaaggatataccagcgagaaaacgaatttacaagactaatcttgtccataagttttatcactgtgttaatccttacaaagataattggaatgaagagtttgatataaaacttgataagtatatagatcctagtgtatttaatctcggttgtcattcgacaaccgattttaaagttgaatttattcttcagcattatttacatgttactatggagtttatccataagaacattgtaaatcaggctaaatcatacaattcaatagctagatctaagtactttcaagcttataacgataaacacgatgagtaccatccgattgtaacaattctgtgacatgtcgcagaaggattacgaaacgttgagtacaaagtgtcatctgacccagttgctgaaactgagaaatattataagatgaaggtaagtcttaaggactttacccttcttcctaatgatatttctaaagttttaaacaactcaggtcactccaaaactcttcgagcgcgagcctatattagtaatcatctacgagatttccttgtagattttgaagctggtagactttcagctatgaaaggtgaacatgaaatataattgttacctttcagaattgaaagttttccaatcaaagatcttatagtacagtcttctaatatgattactaatagagatatgctgaatacaaactggtaacagtttgaaatcagcagttgagcttgcgaggaataatattcttagcaaccaatttctcaatctcacaaggttgtgatcatgaccaaatatgatctgctagtttaaatactatgcctccttaggcctgttagaaacaggcacaagccc

SEQ ID NO: 659 - DNA, 2424 bp, Unknown
  derived from dsRNAs of unknown virus
gggcgaagaggaatcctatggacctcctcttccaggatgagaacctaaccatcctgcctttgtcccctcgttacataacgtaaagcgaaggtatctcttcagttcggtatttctaccttaccttagagaagacaggcacctgttagtgtactagcagcaagagcattgtcaacttagtaaaaagagtcaaagactcaattcataaagatgatacgtcataaaagcaaaaataataagggcctttggcgaacgtacccgtatatacgggacatttcctcaggattaaatattctcgctacactagctccacgtgagtgaagtagcgcgactactctatgcaaatcttataaatccctggttcggaaattaatcacgaaccacggacctgtcgaagccgcaaaacggctgaagaattatcaaaacttcgtcacccgacgggcactggagttaccagttgaaccactagagtggacccgggttgacaagacaggttggccaatcattttgaagccatttaagaactactgtacgtctcaagaccccatgaagaagcatttcgtaatctcagtatttcgatcgttagatctatttaaaggtcatactagtaaaaatatcgagaccatcgttgccccttttacagggtgtcagacggcactagatgaattcacaacttattgtaaaacatgagggaagaatttaaaagaacgacatgaacggtcaaaccgttcatgacgctttcgagaagaaaataatagcataaaggcgaaagccacgtcaggacccaatgggtcctccagcactttaagtctggttttagacgcggtaaagctatcagatagccatgaagtttgtgaaagcattctcatgctagctaaattgacatgttcttcagacctccagaaatggatgaagaagactatcgaggaagctggtcgcctatctaaattaagtagtaagtggaagccccataaggagctttctcttggtcgaattggttttgtacctgataaaggtctcaaaacccgcgttgtagctatcggagacggattttccgcagccgcgttacaaccagtccatgactacttaataactatgttaaaggtgatgcccacaagtgctgcttttaagcaggacaaagcgtgagcaaccctcatttatcgtactctccacggattattctgtggaagttctgatgctacagcttttacagaccggtttccaatcggtccgcaggctgcagttcttgagagtgtaactgatgcgaagttggctatacactgattaagtgtaatccagcgacaatttaaggttccaggtccatgtaatgatacgattaaatatcaagtcggtcagcccatgggctttctttcttcgtggccgttggccacgatcactcaccatgcactcgttgagtacgcagcggaccgggttcttacagaacgcgcttcgaaaagctttaaacgttcaggttattttattttaggcgacgacatcgtcatctttaatgaattagtgtacaacgaatacataattctatgtatcaagttgggacttgacctaaacaaaaacaaaagcactgtctcaacacactgttgcgaatttgcaaaacagctgttttgacgaggtagtcgggtatcggcaattacgcctttatccctactcaaagtatcatatgatcctttgagtgtgttaagtcttttacaagaactttcacacctcggatatagctccatcccagcaattaatttgttgaatctatttccaaagaaatattgaaaacagttaataccatttctctctaatccggagactttcaattacaattgtaatttgatcgactggagtgaagccccaaaggggttatcacctagccagtacggttgggtctggactcaaaaacagttctcagaagcgctttcctacgcctccttgcttataattgagcgagaggttaaaaagttgcgttactctgataagagtaatcggaacttagtgaccaacaaattgtggtataatatccaagaactacaattgtctgatcctaagatcgaaccagcgtacacccgagcattctatgatactctgcaaaacttcggtaaagagttagctaaacttcggtttggtgaaactctgcactatgaatatgcgcagttcatcaagcatgcccggtcattggacccgaacatacatattgggaaagataaacgtactgctgtgaacgaactaaatgttctaatccaagcaataaatcaactgcgaaatccagacaaaagtctagatatttcaaagttcgataattttgaggtacaaatgtaccaaaatataatcgacgccattgcaggctctcggctatgggcttaaacccatagagtggagatttaagattccccgttaatcggggtagtctaaggatccaccacgtcc

SEQ ID NO: 660 - DNA, 2423 bp, Unknown
  derived from dsRNAs of unknown virus
ggggatgacccgcagttttaagcgggtcacaggccctagcttgacaataaaattgcagctgggcgtacctctattagtaacagagatatgtagacctatcctccatacttgctcgagagaaatctcccgtacaagaatgtcccaatttaagaatttaaatgattgatattaaaaataataaacaaacacgaaaattcgggatgagtatgttaaataaaaccactatcgcaatgcttcctaacgttgataaatcaattattaataattgctttaaatacgttacttctctgagagaatgcagaggagataaatatctcgttcaatatctcagcttatcaagtaaaatacttgagaacgctttgttagatgaacctgatgctattcggaatgtcattaaagacaaaggagtaaacataaggatctgtaagaaaacaggtcgccctcattgaattgaaagtagattaaaatcgctttcaaatgatatgggcacttatcttaaactttcaaatactattattaattataaaaatttaataacagttaagtctaagacttctctgaaatctataacattgtctaaagatatagacttcggtacgattaaaatcgccgaagaaaacttcaataacgatcatgtttcacgatttccattcaaaatggaaaagttcgttccacaaggacttatgacttcattgaaatcagaatatagcgaaaagaagggttttacccctccttatcctccattctacttttctttgaaggctggtccaaatgctaatgttctgtcatctcgattactagactcaaagctttgagctggtgatagatctgacattcttgaggatatcctaagtatcaccactctcaattacgagagaggtgagtacaaagaaaacctcatcccgaagtttggaaacttcaagactgatagggtaaatactctatcaaggggtaaaatttcttcggtgtatacaccggggaaacttaaacctagaatatttgcatcagctgattgttttacacaagaatgcttaacgccccttcatgattcacttatgaatatattgaggagtatcccagaagatctttcgcacgatcacaatgattgcgcaaggattctcaagaatagttgagctggaggtaatagattctatggtttttcagatttatctgacgccacggattctatacctaagtacttatatagacaacttctaaattcttatattcctaatctaggagataagtgactagaaattgttgatattgaattttctttaggtaagagtgttattcaaatgctcgaacctacatcaaaattaaatatcaatagtaaagtaaaatacaatactggacaaccgatgggatttctctcatcttggccagcaatggctcttgtccaccattgaatagtttgacttgctgcaggctcttacaaaggagccaaaggtaagtatattattgtaggagatgacatcgtcatcttcgacaacaatatttatacaaactaccttcagctattaggatcattgaagatcccgtataggtctaatatatcttcttcttatgttgaatttgccaaaaggcatttctacaaaggaagtgaagttacagggatatacttatcagcattaaatgctaccaagtattctcctatagacttcttactagaatgatttaatcactctagtagaggttacataatagataaatctaacttttccgtgatattcgattacctaagtataggtaagaatcttcaaagaaaaattgaagaaatatatcttatcccaaaagggaaggatgttacgagaaagagcttagcaaactatgcgttatctctgacgggtagatcaacttgtcacttaacagacaaaaatatcgacgctgctctgaagccaatcatcgatgcttcggccctagcgttaagatctaggttcgatacattacttagcaaagcgaaagccaatgctgaggcctatgattcaatcatagagaactctctaaaggttacacttaagggggaatttgataaaaatcggccatccgttgaattgtataaggaagatatcaagaatgctaggcattcttatataagatatctcgaaagagattgaaaatccctttacactcatgattacaaggatgatagtatagatatagctaatattcttagacctaagaacccaaatgagatattctcaatgagtcctaaatctaaagaatatggcgaagataaatatcgtcgccaagctagatttcaagctgttcatcttttacgaacactttcgctattcaaataacgacatgggtagtgaatccatatgttcgcggtagtagtcgacctacattcacgttcacacgtgagggtgtaggggtccttctacggaagggcagtggcccgctatacgcgggtcatcccc

SEQ ID NO: 661 - DNA, 2402 bp, Unknown
  derived from dsRNAs of unknown virus
gaattacaaaccaatctaatatcaagtaataaagtatacgaaataatcgcgatagtgcgattttatattcgaacataatgctaaacagaaaattaacgtcaaccaaattacgatcattccaatgtggaatagttgtgtctgaaggtgataaacgatcaaacgtcgatcctactcgcatactcttgaggaaggtgaacgctaacgtgtttcatgtatctgaaaacgatattcaaatagtggcaaacagatatggcatgacaagagaagaagtcatggattatatttcaagtgtatgtcaaacaccatttctgaaggggaatggcattgagttccatccgagtgcaccagaccctgaatatcaagacttgtatatgggatattctggtaagttgccatctcgtttgtcaatgaatacaattccaactctttttggcatacatgtgccaaaaagaacgactcttccagaggtgttcccaggcaccgcatttcgtagaaggactaagcttccccagtgtgcgctaatgtgtcatgaattccttattaataatccagacattattaatactgacttttcatatagtaagaaacataaaaataacacggagtttttatccattgttgatgtgaacgagatgcttgattcaatggatgatcaaattatattctctgatggacgtagatccagatttagagcatgtacctatcatcctgaagctgtaactgtattcagagctatagtattatcggccgggacaggaaagaccacacttgccaagagatacccagactgtgtcgacattgatgatgtcttctccagatactctgatgaccggacaacaatccaagagttagtcagagaggaggcttgggatgcactttctgagttgcagactgacatgttagtgaggtatttggaggagtttccatctgaaatagagaaaacattcctaatacatcattgtaaccagtttaagcctaggttaagcccaataattttaggggtgtataaatgtaccaagacagaattaatggacgaaatcaagaaaagaatacttaacaggcattctgaagatgatgattcttcacttgtactaccctcgaaacctgattatatattgggtggtagaaggggtagttattccgtaccagtaaagatagccatgttgaagaggtatggtaccgatctgcgttattatgtagatggtgccgaaccaggaatgttccctggatacactttgcctgagggatttagtgttcatgccttctccggtccagctgcagcaacgtatggagcattttcgcacgctaacgttgcagtagaaacgctagaacataaaggtaagaaatatgctgtggtgaagaatgatgatctaagaacagcaggaaagggcaacgttactgatcattttatcacggcattagaacatttgatcattgagaaacacgatatcattgaatttgataactcatgggttgggaactcctggaagacggttcctgatcacgtaggtgtgatatggtctaaacaaaccagtacaccatcccatgtacctcatcaagctatgttatcacgtcagtcggaagtacctgatgggacttttcagatcataaatgatcaggtgagaagcttcaagtcatttgttaacgaactttgtgatgccattgttaaaatgaaagagttaggatttagtcctattcatgtatggttacaaggcaaattagtcgttcctgatgatatggatgcagggagtagaccgatgaaacggagttttagaaatcagatggacgcgatttatgaggagttggatctaagatctagcaccaaatatcctgatgttccagtttatgttccaaaggaacgaggagtgaaatcaaacatctcagagactatgcgtcttaattgggatacaaccaacgttataccccaggaaagagaagatattgccaaggaagtcagtagtctcatacacatgaggccatatgtattacctagcaatagatttcatgggatgggatctgttgtaacatcatgtcatgctgtttttggtttaggtagaagcgttagagaggtaacggagcaggctgtgtataaattaaaacacggaacctctacttcaggccatctcttggctagctgtcttgcccatttccaacacatgatatggtatgtttacgaggttttcgtaaattctgtagaaaaacgttcgatatatctctttccattcgatgagcctgaaggaggggaatatcacactaaagctgattatgagtatactttacgactgctagaaaagatggtagaagagaaaccgattccacactatgctaagttacacgtgggtcttctttcctctctattctctcagtatgatagttaaggggagattggcgtgtaaatgctc

SEQ ID NO: 662 - DNA, 2408 bp, Unknown
  derived from dsRNAs of unknown virus
gagtaattaattacgaaatttatagaacctagttcgacagaatgcgaaactggttactcaccatactgcaaaacaggggagtttaacatgactaagaatgtaaaaccgaacgtgagacagggaccaagaggagcaagttggctacttgacctattggaaaaggaggctagtcgtaactacgcctccactaaacagctaaacgagcgaaggatgagtaacttgcaccgcgaaatgcgagtcttgtccggatttgaaaagggaaatgaatctgacccggtaattgactttagcagtcgaaaatcttttgcgagatcagtacgagctagagctgaacactggatgaagaacgggaccccgatcggtatgcacaatacagtgttaccacccggagcaacgctaacagcgttaaccaacgcagagaatccgtctgatgtgcattacacaacagacgttgcatttgtaggtgcgccatttgcgggaatttgtgggtgttgtattggacggtcatcccatcgaactgtcatcgatggaactgacttaagcagaacaacggcggacacgctaacattgccagaagaaatggctcttgacaatcgtgcccttccaaaccttgaactgacgtgcatcgcacctctatctcttgtggatgtagagaccagcgttgctgagtttaacaaggagaaaggaaaggacgtgatcaccaagaggcaacgtttgttcagagtgtgtatgtggtgtgcgaatgagatgataacaaacactcatgactttgtccgtttgagtaaagcgatgaaccccaaggttaaaacaccaacgaagaccaaaagagacaacaaaccaacgctcagaaagccgagaaacccggtatctgagatgaacaactacatcaaacatcaacgaatcaacgttgacatgatggcgagtgtgttagatattgctgggattgcagttcgaaagaacatcacaccccagtcattcgtagacgtactcaaaaccatgacgcttaacagcgaggatgcgatggatgttgctggcgagttgcttaactacgagaaccaaaacgatgtgtctgacgagagcactcttgcgaattacgcggtagttagcaaggaattcgaggcattgaagagatctgatacagatcttggaactgtttgcaaggtattaggacattatttctataccatagcgaaaagagacgttaaggaagggaagtgaattgagtaagtcttctaacccaaggaagatagataagccgaaagtactagacggcaaagtagtgttgctaggtatgccgagtggcagtggttggtcaacaatcgttgaacactgggaagcaaccagttcagtcctaggagggcatgtgttaccagttgacctagatgtcataatcaaccaaactattggatggccagtggcccccagtgatgcggacgacgattggcgttggtggatcgacatggatgaacgtgttatgaacgatttcattaaacaggcgcttgtagaagcagtgtcacacatacttgaggttatcttacctcaaagtggtcaccaaattgctattgcgaaaacgccatggagactggatcgtaaagaacatatggacgtagtaatgatggacctacttgaaagtgggaaagtcgagtacgttcacgtgctcccagacaggaagatactggaacgcaattaccagcagagaaatcttgaagaacataaccaaggatcagacgttgaggctgcgatcgctggatttaagaatccaccaaggtcagcagattatttgtcgtatgcaccaaatatcgcgttaattggcgcttttcacatgcgacatgtcttgatcattattgggatggtcttaaatatgcgtacaatactgggtttgtcaaatcctatcgacttcggtagggtccgtagtaataatcggaattataaggcgagcgaaggagatctgttgctaatcttcaagcaatccatggactttagagactctacgtcctcgtatgaactggctctcgctacagagagaacaggacatgctgggcccactagtctcacgaggttcattgagacgtctgcctgggtacgacgacaaggccaaaggaccatgtcttttgacgaagtatcgatcgaaagtagaaccgacacagtgataagaactgtcaatggtgtcgaagaaaagtcgtggaatgtcgagtttgagacattgagtccaattgaagcgatcagaaacagtgaagtacttaggtacctcaccatgaatgaaatcctctacatcacagagatgaggattccttctggatcgtttacaagagcgagtgttaattgagttattgtcagtttgacagtagtggtggctttctttatgaaagtgcaaagagggaggttccgccagaacccaaccccatcac

SEQ ID NO: 663 - DNA, 2297 bp, Unknown
  derived from dsRNAs of unknown virus
gaatcattatagcaatatagaacaaatgcaaaagcatagatgagttaaaggtagtacacaacatgaatccaatcgttacacaagtggaggtggagaatgacgccgcaaatgccttagtaacattgccattgcaagggacccgagcagacatccttaacctgctgattaacttcagcctcgacgtgagtgatgcggcataccgtcgaatcatacgtgaatatcccgacctgttgcgtgaaattaatagagaagtgatactatcgagaaatctcggagttgaaccagtctacactattgaccaaactatcacactaaccgaaggtgtaagtcaagccccccgaaatctgcttaccatccagcgtgtaatggatgaggagcgtaaccatatacgccgacatgtgggattcggtgagactggtgaatacaactatcttcgtggccgcacgttgttacactcttgcaaatttccgaccatggaacccgtacgcgtcattatcgatgacgagggtgtaacaccaagattggtccatacaatggtagccttcctatcaccaagagtcaatgaatacaaatcgtcacgagtaacctatccactccaacttctcgtcaaggatgcacaagccttttcatcaattgagccagatatcaaagcccctatgtacacgcagaaccaaatctataatgaaatagatttgcaaggaacgcgagcacgtataagggtaatcgggtacgttaaacccgaggaaaacgtaccctatgaatatatctggaagcattcgcaccaagattacagagcgcaagtcctaaagccaaaagaagtgatagactcgaacatgcacatcacactggacgcagaattttgcggcggtggggtagcatacagttcgatgatatctgatggcttattcatgtataaaattagaatgacgcacccgctactaacacacattggcatagaagcaaaagacgtaccccagggtatcgttgatgtggtggtaacagcgaggcaggtaagcacgtatgacgaaacagtaaatatagtcaagggcacgaaagaaagaataaccgaaattgaaatcgacttcgttataacctttatcccaatatacgtgggccataacagtctacgccacacgggtcagtccttcctaccgtctgatgtaaaagtgcccgagtcctacagtcttgttcaaatagagtcaccagatagggcgaccctgcgtgatgcagaaaggatactcaccgatgagcttcgcagtacacatcaatggaataatatactagtagcggaagacgcacgtcttcttcataccttaggtaatgtccgtaatgaggaaaagggagtaacatcacgcacaggaatagaacttaacgaaataccatcagatgttgccgacgccatcactaacattgtggcacgtcaccttaaaatatcagcagatattcttgaggcagaagcatcaaccctttttggcccaagtctctccggtaaaggtaattttacagtccccgaggcatatggcggcgaattcaaaaactacacaaacaacactggagtcaacgtagtaacaaccaaacaactcatagctcgttcgatactctcacgattatacgtaaaaagacgcaatggtgagaatacgtatgagcactctgaacgtgcattacacggaacctacatcccgcagacttacatcccttatgatggagtcgttcattcactaatatatacatacacacatgcgctagccaaccttacagttgctggagcgagtaccctatcactattcagctcgaccaatctaagcagatttgccgcaaaaggcgcaaaagttgttggatatctcaaaagttcaccattccccgtgagcaaagaagagttttccgatgacaaatgttcacacatgctgtatctgctccatgatggcgagcgtaagccctttagccttgacgcaatgatcctagatatggctgcacaagcgtataaccaaggcgacattggttcagcggtagtgtggcaccccgaattttgtataattgtattaagtgataaaaaatgtatcaacagaaaactcgtaccagaagagagacttgaatcattggtgctaccacatccgcgtgcaagtcgattcattcagccaaagaagaatgcacacatacgcgtggatggcacctcagcacacacattgactaacattgaggaatcgtatggtcatgccttcgtgcaggcgatgtctgtgtgatggacgcattatgagaatatatttgcacagttcacgctcaagctataatgaaacatc

SEQ ID NO: 664 - DNA, 2199 bp, Unknown
  derived from dsRNAs of unknown virus
gtaaataacaaaacaatttttaaacacaaaaattatatttataatttagctgttcttgtcaattatgcttaaatgcatttcttaactgacaaagacggtgtttcgcttgtatctaagctagacatcaacagttataagatcaaacaacttaaaatcttatgccaaaaagaaaattacaacaacgtaatcccgcattcgtaggctcaccaggaatgagaccaggcggaacgaacatgcccaatagtcctgcacccagaagaactggaggtagagctggcaactccaacattcaagataatgacttcgatgtagttggagatattgatcaattcggcaacgtggaacgtcaaggcccaccctcgcctagacccactcagaaaccaattgtccagaaaggagcagaagtcgtaggtaatatcgcacgtgatgctataacgtctccacaaggtcaagatatgatgaaccaagtggcaagtcaagctggcaagatggcagcagaagcagctggcaacgcagcagtagcagcaggttctagggctaaacaagcaatagacaatcgtagacgaagaaaacaaccccaaccgcaagcaggtggtggaaataacaacaatagaccaacaggaggaaataatatgagaccaggtagaggtaacggaaatggtggtaacggaagcagaagaggcggcggagccggaggacaagcatttgaacctatggattcatggaattcaggaatgcaatctggaccgttcgctgctgcaccagctggacctcgtgtctttattcaaactcctgatgattcgacgttagacaagatcgcatctgtacctcaacagttcttcgacgctggagacaccggtaaatacggtaatcaacagataagaacccaaatcaatgtcattaattggaacgattcttaccaattcggtttaaagaacgcagccacaggcagtctgattcaggatacagtaaaccaagtaattcaaaatgtttgggtggacaaatattcagcaattatacaggatgccatcgcgtacaaaagagggacaaacagtgatattaacaatacacttacttttgacaaaataacgttctatcataacgtgggagcaagatgtcatgcactattagcagagatcaatgcccgacgaaatttcttaccggattatccggaacaaaaccaagctctatcgtcgcttaaatcaaagctagatactgatacctcacttctatcatcggtagaggagctgaaattcaaaatgtccaacttagtgttaccaccagatgtgatggcatattgttgttggatgttccagttaaacaagactattcctgagacaggtagtgatgtctctttggctatgagccactatatgaacaaagatttattggatgtggatagtaattcttttaaacatactaagaaggaaatagacgaactgcttactttattgagctcagcgactgcaacagcgccagctcttactgtagttgaatttcaggtcatcacacaatacttacgtaatacgagattcccttatcaactaatgggtaatcacgtgtttggacatccgaaaatggactacgatccagtttggaatggtatgtgggataacatggcaatttacgctaatgacaacacattaggtagaattaatttgttcggcgaatattcggatagtgatcaattacaagtagcattcccgttatcaccgaataacgtaccaatcgcaacaacagcgcctctaatcatgaatttcggtaaatttggtaccgacaatgacactgatatgaagcgaagcgcgttcccttattggggtttatcagttccagaaaatacttacgaacaaacttacaataataactcaaataaatgggttctagaattagatgcaagttatccaaaaggtattaaaactagtaacacaataggatcggctactttacttactcctcacatctttaacttcggagcaagttcaattattagctatgaatttaacgaatacaataataatggcgcgactttcaattacttaaagcaacgtggtgaaaatacatatcagtacaaaccatcaaagctaagtacacaagacgctgttaagagattctttatacaaatggaaggcatgcaaagtgtcattccacttagtttaagagattaaatatgcttgcagggggacgttttaaacgtcaccc

SEQ ID NO: 665 - DNA, 2277 bp, Unknown
  derived from dsRNAs of unknown virus
ggggaagacgcccataaagcgcctttgcgtacttatgagtgtcaatgaacccccatctggtaccttattcttgcgaatttgggagaacaatttgtgttacaaacgatgtgaaataaaatacaaattacactaaagtcacttttcagtgaaataggcaacggtaaagaatttctatcagaaattgaatctgtgataataccttgaatgacaaaatacttggaaacattccgaagaagagtccgttctaatggtaaacagtgaactatcgacaggtacaaagccttaaatcactttgctaaacaatatgcctctggcatagacgcggcaccaataccgttttgtaaaagtaagccctgcacaaatttaccgaaagagctttatccagtgggacatatcctgaaaagggattctcataaggtaatgatccgtatggtactaactgtgacaagagtttatgaaacactttatgttaaacctcagtgggatttggcagctatacttactccttatagtggtttacttcaactgaaacaggctataaatatttacagcgatttcgttgagagtctctcacttaagcgttttggacaatattccatcaagccttcaagtaagtttattattcgttctaagagaggtcctaacggtccttccattgcttctgcgcatttagacagcttagctgtttatcaaaataagagattatttaatgcacttaagtcttgaaatgatcttttagatcaatcttggttaaatgaatatttaatctgaaatttgaatcagtgtaacactttaggtgttacaaagaaactacacgtaggtaaggtaggagctgtttctgaacctgctggtaaaacaagattgtttgcttacggcgattattggcgagctaacgctttgcgaccgattcatgactgcctaatgcaggtcttaagaaacttaggtaaagttgatgcaacttacaaacaacaattgggttttaaccgattgaagagagtaggtgctagacaatacttctgttttgatctcaagaaagcatcagataggttaccaatcgctctacagctagtgctattatctaagctctttactaagaaaatgtcaggattatggtaccaattaatggtaagcccagtcttctgaatcccccaattacggaggaacgttaaatgacgcgttggtcaacccctcgggcttcttagctcctggccggcctttgcattattccatcatacattagtatgaatggcagcaagagactgtaagctcagaaattgagaaacttttaatgagtacgttattcttggtgatgatatagtgatatgacactacggtgtggctaaaagatatcaagctattttagaaaactttggagtagaaatctctattgagaaatcatttataggcaaacctgaatcaggtgttttcgagttctgcagaagaaattcagtagattataccgagataactggtctgagttgacctttactgacacaatcaacaagaagcatatacaactttgtagacttaatagtttatatggtggagtcagattgacccatttcatacgatactgatttagttcccccctacctgtcattacgaggtagagaccttcttaagattcttttatgagaaaagggaggctcactgcccgaattaacggtaacagcaggtttagtccttccaagcttagaggatgtaaagtacagagtactgtgtctccgtaaaagctctctcgaagaaaattcgaagcagttaaataaagagttcggtcaaaagactttacatgactttatgttaaaagagggcttgcctgtcagtacacaaacaatttcctttaataattatcctcgtcatccgatatgtgatgttttatcaaacattagtaaacaaatgacagatattatatctgagattgttctgttcgaagattcaccttttacagattaccacgaaactccagaacttctagatgttgagtacttacctctaccgacaaagagtttatactttagtccaaaacggggtaatccgcttgcaactagaaagcattcacagtttgtcctttcagcgttatttaacattcaaaagggaaaatcggaatcattaacaacctctgttcaaccgaacagcagtgacttaatgtttgctgatgatttatttacggatgatagtgatggttgataattcagaaaccaatgtcttcattacccggggtatagggttgacttatatagtcagaaaagtatagacgcctcaagaggcgtctacccc

SEQ ID NO: 666 - DNA, 2258 bp, Unknown
  derived from dsRNAs of unknown virus
ggggttgaccctatcgggtcttcttcacattaatgtcgttttcgacttatttaaaggcaccttttctttgatgatcaatcatcgaattgggagagcaaaaatcaaataaatcatgatgattaaaactttcattaataccattcaagcattagcctgatacgtatcaaaaaagtcaaattcatcagttattaattctgaatttaccctgatcaaactttgaattaaggaattttcaacaacgttcaataatcgattaaaaagtaatggaaaagattgaactctttcgagatacaaatctatctataactgatttaaagattatatacttgatgttaaaaccaacaattctattcttgaccctttcatttcaactaataaacaaggttgacccacagaactagtagccataaagccattagcttatgaaggttcaccatgattaagagttatcatgactgtattgcgtctttttgaatctattagattaccagtgaagtttgattctacatcaattacagatgaatataaaggtttacctttagatccaattagtaatgattttgaattatttctaaaccagtggtttaacaaattcggaagaacaataagaaataagttaacacttaccaaattcggatctcacgaaccgagttatcgtctaaaacgtggacccatgggaccatcaatattaacgtcacatctggatgcagtggttttatatgctaataaagtttactttgatattattaccaatttctacacactagtaggatcggaaaatattatctcagagcttattacagctgtagaaacttgctcaaatgtttgtaactcagataaactgattacaggacgaatatcgttagtctcagaatccgccggaaagactagactcttcgctatctgtaacttttgagtccaaagtctcttaaaaccttttcatgaccaattaatggaaacattaaagttatttaaaagtgatggaacatttgaccaaatcaaacaatttgaaagattactaaggttatccaaagataatcaaacttattgttttgacttaacaaaagctactgatcgttttcctataaaattacaacaagttttacttggagtaattgtaagtaaaagtttcgcaaaaagttgagtagacttaattagttactttcctttcgaatataaaactaagttttataaatgatcggttggtcaaccattaggtgcatattcatcatgagctatgttttcacttacacatcacttaattgttcaatattgttatttcaaggtaactcaaagagttcaatgatttaataaatattcactattaggagatgatatagtaatttgagatcggagagtggcgaagtattaccaacaattccttagtactattggagttgatatcaatttacagaaatcctttatcggtttaaccaatactggagaatttgcaaaaagacacttcctcaatggtattaatatatcaggatttggatattccatgatagagaaagcaagtgctgaccctaaaggatgaatccgttttcttgaaatattggaatcggaaggttttacttctactgaagatgtttgtttgttgcccgagactgatgataaggaactttccctatcattaaaatctcacataacatggttatgaacattaagaaacagctttgcccacaatacaatattgtgttatggtaacattgccatttcaaatggagatcttatggaacattatgttcttcaaagacttcaattgttacaagaccaagctatgtcttcgctcaaaagaggacaatatcttagtttaactaagaaaattgaaaatctctctgagtgtcagggtgtaacagtaaaacaagactgtttggacattagctttcaaaatggaaagttagtaagccatccacttgtacattatttgaatataagaaataatatcatatttgataaaatagattattttcaagaccttataaaaacaggtttatatgaccgagaaggtatattatcgtttagatcttataccgaatcagagtatattccaagtttaaatttggatgttttcttcgtgtctgacttaaacgaatttaaatcaaagttaaagattagtgtacagaccagatcctataatagcttgatgaagactattgatattgacttgtcagcggagggggaatacttccgttaagaacaactgttcttaagactaatgtagaagagtaaccaattaaggttgtctcttcaacccc

SEQ ID NO: 667 - DNA, 2236 bp, Unknown
  derived from dsRNAs of unknown virus
ggggttgaacctctagaggttcttcaccagttagtgtcctttctaggagtcttacaaggcaccaatggttatcaaccattgggagagcaattaccgtatactcagatgcaatgatttttcattaacgcaatacaagcattagcttattacgtgttaattacttcatcacataaatctgacattgacaagcaatatacatcaatcataaactgagctaacaaattcgttcaccagtttagtctccgcttacaaaagaacggaaaaacttggactctttcgagatacaagtcaatctataattgagtaaagggacgagtgctgggttcggaaaattatcaacaaaatttagatcctttcataagaacaagtaagaagggcgttcctctggaattaacatcaattgatgctctgatttcatcagattcagcctggatacgagtaattatgactgtattacgtttatttgaatcaatcaaattaccaactaagtttgacgagtcgtcagtcactcaagaatacaaaggtaaacctttggatcccatcgtgaaggacttcaagtcattcctagaaaagtgaatgagaagatttggtaaacgaatatctggtaagttggcactatccaagtttaagtccagcgattgtagttttcgtttcaaatcaggccctatgggaccttcgatattaacttcgcatttatgcgctattgctatacataacaatttggattactctgctatcttcatggaatactgtgcttgcacttcttcaaatgaattagtaagacaatttaatcttgctgttgacatgtgcaaaataaatgttgattctcaagtaaacttgatcgtcgggaagatatctttggcctcggaacctggtggaaaaactagactattcgcaatctgcaacttttgaatacaatcactattaaaaccttttcatgaccaattaatggaaacattacggctgttcaggagtgacggtacgtttgatcagatgaaacaattcaatagaatccttttggaaactaaagataaagtagtcttctcattcgatttatcaaaagcgacagatcgatttcccatcaaattacaacaagcagtgcttgaagtaatcgtctctgcatccttcgcaaaagcgtgagtacaactaattagtcaccttcccttcaaatacaatcataatgattataaatgaaaagttggacaaccgttaggagccttttcgtcttgagctatgtttgctttgacacatcacttgattttgcagtactgtttcttcaaagtatacaatcgtatacaatggtttaatgaatacgctctattgggtgatgacgtggtaatctggaataaagctgtggcggaattctatttccaattcatgaatgacataggggttgatatcaacttacaaaaatctttcattaacttggttaattcaggggagtttgcaaaaaggcactttgcccatggtcaaaatatctccggattcggttttcaaatggtggagcaagcattagcgagcatcaacagttggatccgttttctagaaatacttgaattagagaatttcacttccgctggtgcagttcttcttttgcccggtcataatgtaatcgaactttcgagaagcattataaaccaattaacttgactttggacattaagaaatgcatttgcccaaagaacattactgttctgaggtaacaaaataatttcttactcagatcttcttgagaattatattcttgaacggatcgagctgttgaatcatcaggttaattcttcacttaatagaaaagatatgatcaaactgaaaagtaagatcactcggatctctaagcgttgaggtgtaacagtagaaccaaactgcttggacatttgcttcatcagcaatgaattggtaagccaccctgtcatacgttatctaaatgaaagaaaccttgtcatctttgataagatcggaaatttttatgacacgattaaggatagtctgtacagtcaagagagcactttgaagttatcttcatactcaattgaggaatacattccaaaattaaccgtagacacattcttcacggaagatctaaatgagttaaagttcaaaataaagaacagtgtatattgtaagtcattaatcaaattgatgaaatctaattaactagtactacggggggggtatacctccagggacgtaagtctcagcaaatgcaggatccttaaattaaggatccaacccc

SEQ ID NO: 668 - DNA, 2231 bp, Unknown
  derived from dsRNAs of unknown virus
ggggttgttacctttatggtaacctcaccagttatagagttcctataatatcaatggcacctttgtgatcaacaaagggagagcaacaaccgaatattaacgatgaaattaacttacgtaactaacattaaagcattagcttatcatgttcattatttcagtgattatcaaacgttaaactctgattataactcaatcttaatttgaatttctactttctatgatgaattcaatatccgtttatctaataatggaaagaaatgaactctttcgagatacaaatcgatctatttatggattaaacaatatttattcaaaatagaaaatgagaaaccagttcttgatccattcataaaaacaaataaacaaggaattcctaaagaattatcgatgatttctcatctgattcatgaggattccccttgattaagagttattatgactgttattcgattattcgaatctattaaattagaggaagaatttgatgaatcttcgattgttaataactattctgggaaaccattagaattattatcaaaagaatttaaatcattttctttttcttgattcaacagatttggtaaaagaataaaggataatatggctctacccaaattggcatctcacgaactaagctatcgttttaaaagcggcccaatgggaccttcaattttaaccgcacaccttgactcttatgttattaagaataacaaagaactcttatctatatttatgggttactgtacaattgtacaatcctgacaaatattaagaatatttgaacattccaataacatgattgaaaaggcggataatcaaagtagtaatacaatgattcccgggagaatatcgttggtttcagagagtgctggaaaaactaggctgttcgcaatctgtaacttttgaattcaatcacttttaaaacctcttcatgatcaactaatgttatcattgaaagtatttgaaagcgatggaacttataaccaaattgaacaattccaaagattgattgatcaatctaagaatcatccagtttattgttatgatttatcaaaagctacggacaggtttcctatagaacttcaaaaagtaattcttggagttctagttagtgaagagttcgcagacagatgatcagaacttattggtaatatcccttatcattataaaggcaagcctttttattgaaaagtaggacaaccattaggagctttttcatcttgagctatcttctctctaacccatcatcttgtagttcaattttgttatttcaaagcatacaaacgtatacgatgatttaataaatattcactattaggtgatgatataggaatctgagatactaaagtggcatatgaatatcaacttttcatgaacgacattggggttgaaatcaattaccaaaaatccattatagggaaacctaattctggagaatttgctaagagactcttcctaaatggtcgaaatatttcaggttttggatatcaaatggttactagtgctaacgcatctgtaactggatgaatccgttatctagaaatacttgaacaagaagatttcatatctactagtgctccttttctaaatcccggtctgattgattgtggacttccacaacgttttcaagaccaacttagttgacaatcaacattaaggttaagttttgcccaacgtttattaataaacaatggtaacatcactttttcttattctaatcttctagaatattatattcaggaaagattggaactgttatatcgccaattaagttcttcacttagtagaggtcaatatgttagattaactaaacgtattgttcttctttctaagcgttgaggtttaacagtaaaggttaactgtttggacatcatcttcatcggtgatgaattagtaagccatccgattgtacgttatctaaatgatagaaataatatcatatttgataaaattgaaacatttagtaacctaactcaagataatctgttttcaactgaaggaatattaagcttagcttcttattctcaagaagaattcataccatctatgacgctagatacattctacgtccaagatatcaatgaaactaaatttaaaattaagaatagtatacaatcacgagcttttcgcaaattgatgatttctacgaaatctcatgatacggaggggtaaaacttccaggtttagcaataaaccagctgatgcagacctcttacgaggtcaacccc

SEQ ID NO: 669 - DNA, 2196 bp, Unknown
  derived from dsRNAs of unknown virus
ggggttaacctcaattatgaggttaatagtcttacatcttgaaaattcaagataccgtatacccccggtggcatatgttttgtaagtccatcaaattattctgaagtagacttatataaagcttctaagacaaattttgaatgtttctttctgaagattgggttaccccgttttggtttgaaatataaagatcttgtcggaagtggcatgtattccacctcgtctaattccggtcaagtagaaggttcgttcgggtctgcctccatggttaaacctagtactctgtacaggtcttcaccttgttggttaagagctcaaactattggatgatgtaaagtgtttgatgaaaatagacgtggttgtcagtctatgccccctttagtaaaactttcggagatctccggaacatcgaatattttatctaactgctctatgagagcgaagagagactttattctcagctcacgaagtttacttctaagttgacttaaagtaggaattatagtgataccaaaatctatatatgatggcgggcactctgttccagacatttctcaaagtagtatctcaaagagattcttacctgattgtgataggtaggaggggactaaagatataccaaggttaagttctcaatttgattcgatcatgtatttatacaaatcaatcaagttgtaaatagatttagttgcatttcttaatataacgaaagatataccagtaatttcttgtcccttaacggcttgccgttttgcgaattcgaaagaattgttatactctgcacttataaaagatttacttctatttatatctacacctaattctgataataacttttcgtaccttaatgctacgctttcattccatataacaatatcatcaccaaggataaggtactgattaaacccttttgggtctaaaccagcttctttagcacaatatcacacaagataatgatgtaataaagaaaaggctggtcacgaagataataatcctagtggctgacctacttctcatttcactttaactttagttttacggtgcaagaatcctgtattagtcatcagccttcatcaggtcaatgctaactctttgtttctaaatatttgttttataaggacatattgtaaatatgctggtatacgatctgatgctttgcttagatcaaaacttcacatacctttacttcttactttcaatagacgggcaaaacccgccttttgatcgaaagttgcatcggtgtgagaattatgttttaaacataacatcaagtaatcatgtattggcaacattgcattctgtctccaataatctcctatggtgaacagacgagtcttaccacctggttcacttgatagacctatagttccatgttctatggatttgttagttttatatgttcctttacaaaattcaaatgtttcattaattcaactttgaccaattaattggttaaattttattaatagatcattagaataagtatcgttcatgtaatacatacaatctatatgagcagaagaaatagaaggtccattaggcccagaattggcccgtgatcgaagtttgtcaagtggtttgaaaagtcttagactaggtagcctttctcgtcccattgatttaataaaatcttcaagtgaaaacttgaatttggaaagattaatagtacctgaataaggtttacaaacagaatctatttctagttcaggagtcaaatatattgattcaaagatccttgtaacagtaagtataattcgcttcactaccggattagaaccttgtaataagcctttaatcaaatttaattccttaggaatggaatcttttgacttagctcaattaagtggctcaaatggagtgttgctagctatacactttgctatgtgattgatacctttatatctacctaaagttcatactttcccattatttcttaacctcttcaagaatgtttctagatattgtttaagtcactgttctattagtcgatattcatgtaatgagattgacttattattataagtatgtcgtaagacttgctttagtagtatttcaattttatttcacatcgtaatggaatactagctctccccgtttaagggtgccaatgtttagggattagatttggaactaatggtaggtggcaacaccgaaatgaataacctttccaaagggcagtgaaaactgctcttcccc

SEQ ID NO: 670 - DNA, 2168 bp, Unknown
  derived from dsRNAs of unknown virus
gaatacctttccaacactttgtataaaaacatttaaatttaaagaatgtctacgaatacagttaaaggttcgacatatataacgaatatcgaaactacaaatgtcaacacaatctcaacagttacaccaactggaggtacatttaatataactggtagcctgaacgtgtcagggttggcaactgctgcaaataataatgtcaccgttgatttagatgtcggcagagatgttgatgttggcagaaacgcagttgtagtaaatagcataacgtgtgactcgttatcaataggatcaggtgcgtcaagcacgtcaggatccttaacggctgttaacagtgtaaatgctaacaatggtaatttcaacgttgatgtagatatcgaccaagaccttaatgttggcagaaatgctgtcgtagttggatctttgacgggtggttcactagttaactcgggagattattcaggcacaattaacattaactctggtgctacatcaagtaaaagcattggaataggctataattctacaataaataattcaagtagtattgcaattggaaatggcgcttcatcgacaacaaactcaaccgcaattggagttggtgtattaaccactggggcatcatcaattggtatgggtgaaagctgtgaagcgagcggattgcgttgtatagcgctgggagcgccagcagtcgtaagtggcgaggatgctattggaattggaaggaatgtaatagcttctggtacgcactcaattgtcattggagaaacagcacgggcaacaaaagctgaatcgatagcaattggtcaagcttctttaaccacttcaacgtcaggaatagcgattggtaaaagtgcaaaatctgaaacagcaagcacggggtcaacttcagatggattggccataggaaatggagcacgcgcaaacgctgaacgggcaacatgcattggaaaagattctgtagcatcaagtacggattcaatagctataggaggtccagcgagcgcgacaggaacgcgttcactagcatttggttatcaaacgcaagcgtcagctacggaatccatagctataggtgataatgcgcaagctagttcagcaagatctttggcaataatgaacaattcgttgtcatcagctattgattcaatagcaattggcgccgaaacgcattcaactgctttaaagagtgcagccataggagatgccgccgaagcgactggcgttagtagtcttgcgttaggtcaattcgcaagagccatggcggaagatgcaacaagtattggggcagcaagtcaggcgcaaactacaggatcaatatgtattggacataatggcatagcaagcggtttaaaggctatagcaataggtgatgaagcggatgctacaggatctacatcattggcaattggttcaggcgcaaatgctgcgcatagtaattcaactgcaattggtgatggggcaactaccagtgcagcaaaccaagtgcgtctgggacgaagttccgaaactgtttccataccagggaatttggagctaaatgggttattaaaacccacgtacacatcattaccaacatttaccggtggggcaattggtcagacgtaccgacacgtttacagcgctggaactcttgacaacgttacactgtcattagctgccgcatcaggaggaaacttctatactggagttccacctcaagggatatatatatcgatggtatcgttaaccgttggtgttacggctataaactcgatcgattttagaaatcaggtgttcagtgtgcagcatctaacattacttaccggttataccaatggtcaaaatatatcgcaccatggtatggagtccaatacggtaataagtaacttcgacatgttaccagctgtagtatcggtgacgggtgcggcaccgcagttcaaaatacgtagctctagtccaaatggaagccaggtaaatactgtgcccagagtaactttcacgcttgtaagaattgcgtaataagggcagtatcattaaatatgtatgacaatttattcacgttcatgaaatagaattttattaagtagcgaacgtaaatataaagagatataaaagtattcattaaaagttcacttgttacaaacatttcccagtggtatacagtgttaagagaggtcaaaaagctc

SEQ ID NO: 671 - DNA, 2160 bp, Unknown
  derived from dsRNAs of unknown virus
gaataaacaacccctttcgaaaacaaaagtgaaataaagcgaatcaaagcacaaatgccagctactgagcagtacattgccgacttcttcagtatggtgtctgcaccgagtgagagtaccatgatgaacggcgcgttgcagtcgccagcgaacccacattgcgacctcttcattatggagggggcgaagactattatcaccaacgcgtcgacaaaccgaatcgaggtgcttcttgatccagaggcgacacttcgcaacggccaaccgaagctgtatgcatacgaatataataatgcaggcaacattgtcgcaatgaccgacgtcgatgttagcgctggctccagcaacttctcctgcgcatctgtcatcgcggcgcgtctggacgtgcagaactcttcctcgcacatggaggtatccggctctatgactggtgccgtgttgaacacagtgccaaaggatgtgcacgcgctcacccagacttccctgaagcaaaagtgtcgccgtaagtccgatcagacgatgtgcttgatgaaggacaacggtatcactctgcatggtatcaccagtcacctcggtaccaagcatgcaactatggagacgggcgttacggcaaaccgtgaatcctggttaaagacgtacaacaaggctttggtgaccgctatcgaccctaccagtggttttaccgcttcgggagtatccttcgccggagctgcggcgaacgcggacattacggtggccaccacaatcgcacagttggctcccaccaatgcggatcgcttgtgggacacgaatttcctgacagagaaacccttcactcagggtacgtttggagcggtgcttgatattaaggccgagctggcgatgactgccaatgatagcgatcagtttgatggtgagttcatgtgtgttctactggaccaggagggtaagctcctgtcgaacgctagtcaaacggtgacgatgacgaacgctatctcggcgaatgacgtgcttagcattgatctccattttgagtttcccaagcaggcgcgtcctatcgcacgtgcatacgtgtatctcaagaactccacgaccactgctgtgcaacttgcggcacacgcgaatacgcccgtgctgagtgcgacccttcgtggcctcgagtgcacgagtgacatccccgaccgtgacatgtttattgttgtggctgagggtgtgaactcggaagcggcgatcacagttcaggttggtctggtcgtgagcggaattccatctgcagaccagacgttcatctccggaggtagcgcatatgacggcgcgaactatgcgaagattatgtcgtacctgcatgcagtgctcttgcagatgggccgtgccagcctacataacgaggtcgaggacctgcgttctgttatcacccatctgatgaagactccgcagcacatggaggccctacatgcgttcagcttttccgatatcggtaagctgtttggccgagtcgccggcgctgtgcgctcgggtgtccgtgggttcgataatgtgctgaagcacgctctgccagtactcggcaccatcggaaaagttgcacgtgggatttcgagtgccccaattattggtggattcgcccgcgaagtggctgatgtcgccgatacggccggccgctttggctcggagattcacaggtacactcagcatgcggactcccacgaccgcatgaatcgcctgtatgccatgtcggactattaggacagagacagcgccacgttcaccacaactcgattcccgacaatcgtattacgcaatggaagacctaatcccgggatgatgatgagcattacaccgcttcgccataaatccagcgctacgaaactaacatacgatagcgacatgcgggaactaatggagcaattcggcgtaatagactttgaggtacacccacagaatgttggaccgataaaaggtgagtcatgggaaatggcggccaccatgagtatgcttgggcggccaggcaactatactggcacacttgaggactacagcgatagcgtcgcgagcttcggcccagtacgtggcgtgaatgtcaaaagaaaactgctaaaacatgagaagctttatacatactcggacttttcgacagtggacgtctccccagacgtacattgatagaggggtgttgaaagcatc

SEQ ID NO: 672 - DNA, 2156 bp, Unknown
  derived from dsRNAs of unknown virus
ggggtcgtaccctttcgggtacgatgtctatatgacagttttgcatgctcccacataattgacaccgcgaaagcgagtgagtaaataagatataaataccttatgattacaaatgcactgaaaaagaaccacagatggataactgtcttaagacagatatcacctatgatactttccctcagcattcctcacttaagcagtgaacacatgaataagttcgaccagctagttaatcaccttctaacccataagggagaagttgagactataaggttgattaagtcttatagatctttcttcagagatattctctgaagcaagataacataaatcttcctttccacaaagtggataaggataattttcctaaggttttaaaaccttggaaagatttagctgatggaggtctttatgaacaaagatctcttcactcattatggagacttagtgaactctttaggcttccgccttctgaggacactagtaccataacggacgattctactagtagaaaatcgcttattgaagtgattgttcatgacataggtaagacagacttttctgttttaccaaaagaactgcctaagttgagcatgaatttatctaacaaggcaggaccgaacggtcctgccacgttatcagcctatgcagatgtgcgtcctcttgaagaggacgcagatctgtatgaggctgtcaaatcaaaacttcagttaactaaaccgaagattgacttagatatccatgctagacgcaagattaaaggaaactttaatcattctaaactagtcttcttaccggataagtcgggtaaaacccgagtaatcgcgattggagactggtggtcgaatctagccttgacggacttacacctggcatttatgtcaggattaaagaaacttcaaggagattgcacctatgtacaagacaagatcccaaaactaataaaaagaatgggacctaacttattttcttcagacatgtcagcgtttaccgataggtttccaatagaaatagaggaagctatcgttaaaagcaggtatggtgaagagataggagtcttatggagacgaatcttacaaagaaagttcccgtcaaaagacggttacattcaatataaggtcgggaaccccatgggcttattaagctcatgggctgtctcttcgtttacacaccactatataaagtggtggtgtagacgaaaacacccagaagtcaagggatacaaatccttagtcttgggtgatgacagcctttgtaacaatgaggatgtgtataatacatacctcactgtaataaaggaactcggagtttccataagccacgataaatgctctgttagtaaagacggctatgccgaatttgctaaaagattatttacaccttctggagaaataacaggaatacctgttgatatcttaaaaggtgtccgtcatgatcctagcttattcattgaattagttaagatcatgaggagtcgtgggtacaaagatgagcatatagcacccggagttcagtcattactgttatcaatgcctaaaaaggtcatgatgacagttctgtttgtactctcatcttctgaagactacacaggcatgcctccccttgtaattggagagggtggtgccttactagtagaccccccggtttacggagggttatcagaagactccatgaaatctcatattgagcaagctcaaagagaaattttctggagagaggtggatgataaaatccatggagagggatcaagccctccaactgaatctcctaaacagagatcacagatgaacataccaaagtgtcatcccgcctacgctgatatacaaactggtatttaccagtatatgtatcacggagacgggtataacgaattcagtatattcgaggcttggcaacaaaataaggatttcgatttggtaaatataccttcgatgaacccttataagtacacaatcagaaaccaaagggtttctgaggctcggtataatgttcttaagaaagcaagagcatttgcccttggattccaagaatattctaccgaagtacctatgaagatatcaaacagttacttgttccaccttgcttttgcaaggatgaatgagtaacatggtgacaccttccatctgcggaagtcataccctcacgggtatgacccc

SEQ ID NO: 673 - DNA, 2142 bp, Unknown
  derived from dsRNAs of unknown virus
ggattattgtattgacaaaatcaaacgacaagatgatgactgacaacgaaaacacaaaatggacagtgaagagccacagggttcaatccaatggaaaagaaaataaaaaagtaacagtagtacaaaatgatggtaaagtagggatgtccttgctatctatgtcagatacatttttaagtaattgtggtgatgaaatagaacgtgtgacgtatgcggctatgtacagagcggctaatatgcttctaacctatagtaatagtaatatgatacacagtgatgtgtcatatgatccggaaagtgtatccggtatgattgccatgatttcacagatattctcgatagagtacatagatgcgatggatatggtgaatgtcttgatggatgtggtatgggttcctcgtttttgggcgaaattgcacgacgtagaggaacagacaatcgaagagcgtattgaaaatatgatgtgttctgaaatcttcgttgagccgtacatgatacaacttatatctagtgcgacaatgatgaaaaagatggtagatatagttagagatgtgtggtgtgacgaggaaaaaagatgttggttttatgagactatggattctgatgatgaaaatgaaacggtaacaccattcgtggcgatgatacgggatgtgtggtcggcgtttggtgttagtctattcgtatcagagatagatggtgacatgggtacgattaacatatctagacaggaatgcatgattaaatttccaaacagtgaggcagtgccatcgcaggctgcagatgttctgttccttggagataatttgtgcgaatattatcaaatgatcgtacaacataaagatgataggaagaaagataatttacacaccataccggaacttcaagatagagacttttggatatccagatgtatggttaaaaatgccactaatggtgaatcatttgcaaattctaacaaattggctaatatgtgggacttggtgaatgaccatatagatacgttgttaccaaagtgtgataatccatggcctatctttgcatttattgaaacgataacggtgggtaatagacattgtcctattggatgcttgtctccattaacatcggttattccgcatcagttacggatagatggaaaggattttcctggacaggttgattcgctacataaatatccagagatcgaagctgagttgcatgactggttgttggatcctacagtagactataagtttaaaactttcttagaagaagatggtgaacagtatgctatctatatacatggaagttgtcatgatgaaagattttcatgtactgatcatcttacaaaaataaatttacgtgatgtaatctacatacatacaaagaacggtcaactcaggaaagagatacccgcaattaaaatttacgaattattaatggacctacagaacatatggcgtactttcagccaacccggctatagtgtgtcaaaatcagttgatgtacgatatggacagcattcgcgtggtaatagtacatatacagaaagaacagattatccttacgcattagtatcgacactacgatggacaaagagtaacagagtacctaagcctgtggatgtcacggtgacggttgatacaggaaaaggcctttcaacactaactacgacagtgtgctatcagccatggacttcatatgctactgccaaacacgaatacgacagaatgaaaccaatagatcatccattgatgggtgagatagcacaagagaaacttggtggaactaaagtggatatcaatatgcccgttaaagctggattaggagctcctgtggcatatgtaggttcacgattagctccagtaagtttgggtgtgttgctagcggcgatagcgaatattcgttacgtacatggtggggaacgaaaaccgtatagttgtaatgctagtaatctgaatttactggtatcagtatttctgtttgatatacccattctcacaccactggaaattacttcatggtataatatcacaagtccataatagactaatatcgtagtcacaaatctacgtcgtttgatttacaacggcaagccgcccggtgtacgtggaacactgctcggcgctcgaaccagagcaacaatacacataaaaacatacc

SEQ ID NO: 674 - DNA, 2062 bp, Unknown
  derived from dsRNAs of unknown virus
gaatataacaactcacttttattactttaaagcaaattcatatataattaaaatgtcaatcgttgaacgcactcgtgcttatgctacggaagtagctgagaccgctcttaatggttttgacaggcaagcgcgcggtacgttgccagcgcctaacggcgatgagaacgtgcgtctattcacggcgcgtggtggatcggcggttacattggccgcaggtactcgctcggcggcagtcgtgtacgatccagaagccaccttgaggaacggccaactggctgtttacatttacgaacgaagcgctaccgatgctgtcaccgctgtccagcgggttgcgcttggcaggagttcagacgagttcatttccgctggaatccttagctctggtcttaaggtctttaactcttctggtgttgatgtgattggcggaacgcaaacggcaggcgtacttacgtctgttcctcgcgatatctcgacgctcaccaccaccgatgttgccaacttcagccctaaccacgaaagggatcttgtgagcggcgtggtttcacgtgaagatgcgacgatgaccctggccctcaccgaacatcttggcaaaaagatgtgtctggctcgtgctaatacgaccagtaatttggtgaagcgcacatgggatgatgggattggcactaggcgcactacctctggtgagtctctggggcccagtgccgtgacagcgtttgctagcattgggaccggcgttaggactgctcagcaagtacttgatgcaccccaattccaccttcttgattccaataacctgtcggcgtctaacaacccactcacactcgcgacattcaacgttgacttctcagtccatgttgagttcgatgattccaacgctgccgacaccagctataggatggaccttaaggctcttgctatcgatgcctctgggacgatcatcacttcaattgatatgactgatgtgacgaacgtgaccgctgatcaatcgttcatgtgcattgctagaggctccttgaccagcagcacggtcccgattgcccgtgtcgttgtcggtgttgatcgtactcagcaatcctttactactctggactacaagccagcgttctcgacgaactccataagtgcgtacgaagagacagcagacgtggcggcgcgcccgattcacgtttgcgttttcgaaggtttgaatgcatcagcaacaatcaacgttagctcatacgcagttctgacgggcgttccggattcttcgaacgtctttatcgcgtcggctcaagaagatgacaatgatgtgacggactttaattcagttgagattttcatgaagtctgtgattcgatcgctccctcgtgcattcacggtgagtggccacggtgaggtgacgcgaaacttaaccgcaatgtacaattccgaggaagttgacgtggccttcaaagcgatgtcattcggagatgttaccagaggggttaggaagctaggctcactggcgaaagggaccgcgaaggacctgccccacctccttagcgagctgaagccgtatgttgaacttgccggtactggaatgtcgatgatgccggggactgccggtagagttggagccatggtccaagcgggtgcacgacgcttctgaatggcatgccatttccctagcgtaattgaaatcgatggcgtatataaggaggggttgattcatactctcttcatgacaaattttccattaaacaggaaatattcacttcgtgaagggctgtacgttgatgaaaatttgaaagatattggtcgaccaattgggagcgtactacgacgttgcggtgttacgcatctatccctacgacgcgtggtatcggttgaaggacgttcttgggaaatggcttgcgccaggagggctttaggccataatggagtctattcaggcgtggtatttagtgctagcgacgatagagtggattatggcccagtaccaggtatacttattaagaaacgattatatgataaactgctctatagtgataaaataaaatttgatctactttcccggtagtgaaatgaagttgtttgaaacatc

SEQ ID NO: 675 - DNA, 2092 bp, Unknown
  derived from dsRNAs of unknown virus
gtataaaataatttttcttttcgaagaaataaataagtctatattgggacttatattctatatctgatggtctattatctggaatttatcagaaattagaacagtgtcatggctgttatccaatatcatctagatattgtcaggataaagatagcatcacattcacgtaatggaggaatctatgaattcaaataatcctagcgattattctaaagctgcatttatcgcaggcggtatgccgtcgggacgcataagtaaaccacctttccaaacaccaggcgcggaagggtcagcaccaagcactccagtgggcaaagcaccaccaggcgcttcaaccgggaacgagagtaagtttagtaaggcggcgcgacttggacgtaagaatccaatgacatcacctaaagctaagggacagtctaccaaagctcagactaaaactaaaacacaaactcaaaaacaaaaggagaacaacatgccaaacacaggaacacaaaaggcggacaagggtccaaagaacatgaatcctttcagaccaccttttcctaaactaccaacggatgacgatgagcctagaatgcgcttatcaattccacaaggtcttgaagactatcgtgacggaactactatctcgtttaatacggataattttccaggattagctccagaaccagagaagttccaacggaacggaagctggacaaatacgaatgacgcaacccaagttgtttctaacgtccgtactcactatcaagtcattgattgtgattacttacctcaaggattttacggtctagatggtaatactggtggatgggatacaacacaaggagacattcataatgaagcaacatcccgtcaatataatgcatacgtgagacgtcgtaattcaaacatcgagttgaagaacagtgtcacaaacaagaataccttcatatatcacggtaccaaccttaaattggttgcagaagttatttgtttaatgaatcgacaagcttattataaagccgcttctaatattgacaaccctgcactgaatcgaattgcacaagtattaaataaatcagctctctggaaagtcagaaatgatgctgttaatgctttagaaagtagctttgtacctaagtatgctgttgatcagtataactggttactcggtaattatcaaatgactccatttgataccggtggtacacaattctttgtcactccaatgatgagtgaactcttaattgatctgggtttagcagctgatgaaacagaaattcaaacagctttagacaactatacagataagttccgagttaagatagcagctattacagctgacgtctactcgacggttcctgcaagaattaatggtacagaattagtagatcttggaaactcgtctactctattattctaccaatcaacacgtagattccttaacggattctactcagagttagccaagtacgaaagtggttggatgcaaatgaatgactggcgaagaccagcctcgacttacgggtatgatgctggatttaatgatatatataacaactggtcttttcgacgctggtcgtcagcgacaaatattacaattttaccacctcaaattagtggtacaactgatacagtagttaactatacactttcacctaatgataatgccgttacctattatggtagtagtcaatccgaaaatcaacaacagtttcacgtgattgagtcaatggcagacagatttgttgggtgtagcccgctattctatagcatggacactacctggagcacatcatctggcgattctcgtcagtatcttgtgtatggtagctatgatggtacaattgatgcgtctgatcaattaccatatgaatctcgaactaatataattgttccgggaaacaatacttatccgtttgttcaggataattatgtctctaaagtacttagttcttcaacgactggattacaaacagtaactcaagtcgatggactaggtcaatctctgtggtatctaccattaggtaagattctgtctgaacagaagattatggctcgtaaagttttaccttaagtaaaacccggttggaatttattccttccggtc

SEQ ID NO: 676 - DNA, 2098 bp, Unknown
  derived from dsRNAs of unknown virus
gaataattagacctttacatttaaaaacaagaaaacagttttaaagatggacgcacaaagttatgttgcagaagtagcccgcgtggtagtcaacccatatgggaactccaccagtggatcgctaatggcacccaacagcacgactgacgccatgatctacgtttccgagggagctaacaccctatctctggcatccaccaccacctccgttgttgcgttgtacgacgccgaagctactttcagaaatggacaagcccaggtgtacgcctacgaacgtaattccgcgaacgttgttactggtttgacgctaatcccggttggacgtccctccaccgatttcctctccgggggtatcatctcttcctcgatgaaggtgtctaacacatctgcatccgacagcattgcaggtacccagtcccaagcagtattgcactccatcccaagagacgcgtctgcgcttacggcgactagtttggtcctcaacgtgcgtgataagcaaaataagttgatcactaacatcaattcaaaattcgatggcacacagaccaccagtccaactgagcacatgggcgagaagatggcgctactccgtgacggagctaaatccaatcgcgtatccatgggcttcaacatcgctacgtccgctgcaaccgcagctgatggcattattggtgctgaagattttttggtcacaaaggtggccaactttagtgcagggcaaacgtttggtgactatgcagcttccgcgatctacgactcgtcacgcgctggtaacaccaaaaacccactgaccttctccaccttcaaggttcaattcagattggacatcaattgcgtggccgaatccgctattgttgccggaacctccaggttcgcgttggtagccttggattcagcaaataaattgttgacctctgtggacatcacaaccgagacccccggcgatgcggtattcgacctttccattgatgaaacgttggtgtctacaacctctccaattggacgagtcatgttgttctgtactgaggctaccgatagtggcggtaccgtcgcgcaccaagtggatgcccttaataagaatttgaaacgttcagacactgtatcctctggccgtatcgaggccgttgaagaaactgctgacttagcatcacgtggagtgcacgtctgtgttctcgagggtgtaaacgagaaagcgtccattaactttcacgcagcaaatgtgattgcaggtatcccagacagtagcaccgccttcattgcgggctcaggatccatggtctccccagactatgacttatccgatgtcaccgatctactccaaacattcaagttcaacgtccctcgtgcttataccacctccggtgcatccgcagcaggagagatgtacttcaaggcggtaagtgactccccaatgaacgctgcaatgcacgcacgttcattcaaaaagatcggcagagcctttagaaagatcggtaacgtagctaagaaagtgagatcgcagctgtctgaccacgtcagagatgtccaaccatacctcacacaagccacacaaatcctaggtgatattggaggcgagcgtgcccagatggcgctacaaggtatcgatagggcccagcagatgattgagcagggtagagacatgggcgtccttcaggcgtcatatggcatccccggccttagcaagccatccttcctatgaggcacaagccattttccatccgtctacgatgagaacggtgtgacgaagccaggcatactttttgagattcgattaaacacaggtagcagcattgacaggtcacttgaagaagtaaccattcatatgcgaaagctacttggcgctcttggagtaacgtcaatagatgtcatacccgatcatcgcattaagggtaggtcttgggaaatggctgcaatcatgtgcgcacttggataccacggtgtgtactcaggagcgttaaagagctataactcaaaaaagatctattttgacctcgtcgacgacataactacaaaaagaaaactatcaaaaaacctgttaacgagtattgaattaccttacgtcactatccctggtgcataaggttggtctaaaaacatc

SEQ ID NO: 677 - DNA, 2091 bp, Unknown
  derived from dsRNAs of unknown virus
gagatatatttatattgaatttagagaaactgtaaccagttcccttttgaagtagaagcccctcatgtagctgcatcattcgaccctcgctacggtggtcctaggtgttaagttgcgcttatactgcatatcaatgaatcatctcaaacgccgggaggcaaaacgatatgaaacaaaataaaacaaacattgaaaatacgagaaagaacgcttttctgctcagcggattactatcagccgtgtctgatgtaatgagtagaagccctgcttatcttaagagcatgggctacaaacagtggaggaatcccttcacggaaacccagatgcatgcagctgctaaagcttttgctgaagggacaaccaacgtagagacgaagcacatgatgcacatgctccgaaactttaccaacacaaacaacaacgtgcatgcactttatacctttgtcaagggtttgtgcacactaggaaacacgacatctgatgatatcgtcaattttattgatgaatttgactgcgataaaccgatcccacaagtgagtgacgtgactcgagacgtgcgtaatgcaggtcttgtaaggcacatgaatgatcttgtcatgtttggtgaatacatgcaggaccatgtcgacattagcctcataggcgaagatcctctttcgaaacgcagtgctgaattactgtacgaaacgctctggtattatgatgatgatgatacgttttctggtttcagatttgacacccaaaacaacgcagatttcgtccccgttggaccagtatctgggtatggtgaggagctacaacggccacgtccagcaagctttgtcgcgctgttcaaagccacgtctttgcaatccatcccacccgtaagtactgatgttcttaggatcttcgacgacgccattgaggccaagtttactgatcacgaggtgacgtacgtcaatcgcactgattccgaccacttttacaatttgaacggtgaaaggattgaggttatcggccacatcagagaccgtactggatatgacactaccagaacgtctgcgtttgggtactcagaggatggcatccttcacacaatgttcgtgcctgaagaccggcgcacttacaatgtcaaagagcctaagttttcgccagctaagaacgggtatgtataccgatctgttggctccagaagttatgaccaagatcagtcttttgctgaggggtcttactctccttcaaaccgggagtcactgactattggagaactgctatcctgtctgccacaagaaatgcgcgacacgttgtaccagtacacatgcatcatgccttccatgaagtgggttgagaaacgctcaggaaagaaggtatatacgacattctctctgtcgtacagagagttcattcggaaaaccgaacgtgatatgatacaaccaacccaaatgccaagtgatcttcgatccctccagaagcttcaggacatccagttcgacgctctctctcaaagaggtaagaagattttgtcttttacaagccatgaccgttcaagttttggttcagactactcaatcgttgacgattggggagacgaaactttgaacgtccacgctacgcgccctcgtgctaatgctgcacgagtgttcggtgactactacaatgacccaaccataccattggggcaagttattgatactttagctggtcaccagaacagctttgaacatttggacgttgatgtcagattagccttcgctacgaacctgtttgatgaaatcagaccggttgaagttagctcgccggccagtaataatattggtgaccacaaacaagcgagcgaaaccgtatcactcagatggttaaaacacgtaccggttatgtgggccgatgacacaaagacgcatgttactagtggaagtctagaacgtatgattgcaactatcaagcaattgactatagatgatgccgatcgaagcggcagagtcaccgtgattgtacccctcagggtatgagcacgtggtcctcatggggagtcagggttagtctcccccccatgttgtaaaagcaacatcaatttaaacacccgggatgccaagttgacgacttgatcccacc

SEQ ID NO: 678 - DNA, 2070 bp, Unknown
  derived from dsRNAs of unknown virus
gaatcttacacacacttaacgtaacaatgtcaacaagagtaaacattacaaagctaacagaagaatggagagggccagaagtgattctactacgaatcaaagcttcagcacgagtataccatgaacagtatcgtcgagcatacctagcattcaggcataggctaatgtactttgacatccccatcatcgtattctcaagtgtcaacagcgtgctaatcgccggagggaaaaacttcttgcaacccgacttaatcgaagtaaccacatgcatgctagcgctagttaccggtatcatacaagcgttgcgtacattcctaaaaattgatgagactagggaaaactgtctagtcacgtacaaggatttatttcgtttgttttgtgaggtgtccaccattctagcccagccacttagaagccgcagcgtcgatgcccaaaaattcatgcttgataagatcgcagaattcaaggagatcatggacaaagcggtaattctagaagagaaaacgaaatccaatcctatatatttggatggtctaacctgggacgttggaggagtggatgagtctacagacagctcatcgccgcgacggcatccggacgcacatctgtcagagatcccaagtctagaattctcttccattaagaaagaggattactatgacgacggagccgatggagatgcaattaccggaaaagaggaggcgaatatgattattgccacacaagaacatcaaacaccgccagtcgaatatcatgcgtcaacttggggcacaaataacaggaggaattttcttgacaaactgccggacgagttgcagcgccacatttacagctacgcctttgatgtagtaacttacgcatggagatgtgctaaccatacgcttccatccccgattgacttgagtgcgcaaaacacagcaacgcctctgttgattcatgctctcgaaacaaaccccagggtgagtacaatgagtctaatccatctaatggaagaggtgcgcataactagtccccccataatttgggcaatgtcggatctaggaatgtttctacacaatcgtgactgtcttaatggcaataatggtgtactacatccggacaacaaacccattgtacacaacgcccccctggaccgtcatgatatcgccggaatatttaatctgttcaaccaagtggctctcattctacgtttgatgtcaattgtcaaacaggaatgtcgagccagaaacaagttatgtgatggccgtaacaaatgttttgtggtgcgagaacagccgtggataaccggtcatgcgatatttgatgatgtcaactatcgcacactgggttgtctgcaagcggctcatcgcaccgttgaagtagaatgtggcccactgcgtcagggcgccaatcgggccaaccatgttcgggtacactgcataatgcaaattgagctaatattccgggcatacatgcaaggcttaatgcccattgggaactatcaaaccttgatgaaaaacacctgtgcattattcgctagcacgtacggagtgctaacattacacgaaataatcgtgaactggcacgcacattgggcaccaccagttctgactggtggtttcgcccataaacgtgtcgcagctctagataagctgagagcgttaatttccaaagatccgcgatccaggttcatgtcgaacaaagtcaaaaagagtgacatgacatctctaaagggaattgccgaatgggaaatggcgtcaggggcagcgatagcgggagaggtgctacgtatgatccgttattgggatagtaccgtacctggaaacgatacgaccaaggaggttgttggtggcacattggccatagtcaatggcggaagaaccagtacaggtttgattctatgtcctagatgtcaacgcgcatccgtataccgctataaatgtacgtgctctcagaaattcaaaactagtaagctaaaaattgttttgcccaatgaattccgttaatgtcgaaaacggtaagtgcggctgtagcgtaaagttgtagaaatgcaacgtgtagctttcaggaaaggtgtgtgtggaaaacatc

SEQ ID NO: 679 - DNA, 2001 bp, Unknown
  derived from dsRNAs of unknown virus
gaatataattgattgagagaaaaatcataatattaaatacaaagatcgaaattaagacaaaagaatggcgaaccctatgagcaccgctgattatgcagctgattatgtaacaaacttatttgatccaacaaaaggtaaaatgcttgcatcgcttaccaacaatgatggatacgttttgtcaaccgttggtaacgcaaccattacaacagcaactactactactaaggtattgcaagtaaatgatccattatcatatgttacaggtgcatttaaacaatacacctttgaaatgaacagttctggcgtatgcaccaaagtaattactagtagtctcgatagaccttctactaactacagagcacttgcacctgttgcctttatggctgagtcaggaaatcaatcaaacttcaatgataaacaaggtacaagtggtgttggcatcatcgcagatgttctcgatgatttaaatacagtcagcattactgatctcgcagtattatcaatggaaaagaatgatttcgtacaaggtggtccaggtgatcagcttggcggttgcgttgttaatcgcgcatatggatcaaacagacttaagacaggtgtaggagtcatcaatccaggtgatgcacgtgtatatcaagctgattcattgagttcattggcagaatttcctaccgctaacggacacgctataaacggttctactgacatggaaggactagtggtgtttaacagtcagctaattgcagcaacaaaccctgatggtaaactgagggttacaaacttcagaacgtcaaagataactatagattatacaatctcatgtacaatcggtggcactgcaggtgacatcttttctgacgttgaaatacttgacttatctggcgctgtaattagcacagtgagagttaggcatgaaattcctgccgcaggtcaattcgaatttgaacatactgttgttcatagcgacatgtctggaccagcagctgatgttagaattaagctaactgatacgaatcaagccacaactttcgcatttcaacaatatggtgtgaccgttactgctgaagaacaaggaatcaccagcgcaacttctgatactggtgtcatttacttcgtttatgagggtctaaatggtggcgcaacgttatcgactaagtacactggctttaatgatattgttccgagcttcaactcaagacaatcacttatcgctccaccttcacatgaagttaatatgacaagagcgaagatgttaatcgatacaacacttactgattgttttagaacgttcaaatcgaactacaatccacagtttagagctttaatgcctcaaattgcagccgcttataactctgatatgaatacgggaactgttaaggccgcgcatggaattggaagcatattcagaaaggcaattcatggtggaagagcagtgactgaattcattcatcacaatagacgtgccattaaaactggaatgaaaattgcagatagatttggttaccttgaaggtggtggtgaagctgcagacattggaagtgaaattggcatactttgactggcggcatattttcctacgattatggcatatcctgatggcagctatgatagtcacaaggtttacgaaatgacattatcatcaagtagacaagggtcaaataactatagagtagttaacggtgtacattacgatacagagttgattgacattaatcctttaatgtctgaaattctcaaagataataacatatcatatgttagtgttgttgaaccgcgaaaagtgcatgacagatcatgggaaatgtctgtggctcttactgcaataagaggtcgatcaacatttgctactggtgttctaacatcgtatgaaaataaacatcctcaattcgggccaatagttggacttgataaaaagataaaggtatttaacggattacctctcgaacatgtttaaatcattttcctggttgaaaaactattaatcacattattaaaaagctc

SEQ ID NO: 680 - DNA, 2006 bp, Unknown
  derived from dsRNAs of unknown virus
gtaaagaaacttttcttttccccgacgacatacgggacctctgaaccttccaagttcggaaacaagtgtcagtattaacctaataatatttaactaatgtatccattacattcaggttacagacgtaaccgaacgattttatcgttagtacctcaaataggaggtaaacgcaatcccaattccttacaaccaggaactggagcaccactgagtcaaccgggcgttgcacccagaccagtaggatcacccaagcaatttgttgaagtatccactaccggacaagctaaaacagttgcagaatcacaaccgatgacagccacttcgctggaatcaaaccgcaaaattaacaaaacaaaacgcatgccatctacaaaacgtggaaagaagaaagaggaaaaagacttcatgtacgtccctcgaggtggacgacctaaaccaccggagaaacccggtttacagtatacaactaaggatcgtgtccctagcggtgccatcccttacagagatggaccaccaactttcacgccatcttttccactaggaaagattggagaactaccgaataagaaacaaactacagtaggatgggatctttcagctcaaaaactgaataacattcgctgctcaattcaagtagtcagcgcggccttctttggccaagtaccatcattctctacaggccctggtaaattagataataatttagacgatacacaaggacgtatcttcggcacattttataatcagattagagctatttatcaagatagatacaatctgaacacacagtttgtcaagacattcacagcccaaaatattttcacgtacttccatgatgtgcacgcacttcatgttgaatttgtttgctacttacaactagcagcatattacaagaacgttgattcagggatggagaatattctcctagataacatcggcatcgttcttaacacagatgtctttaccgttattcgaaacgacatgtcacgtgcgttacgtttttcttacttaccacagaaagtaattgactctaactacgagatgttccaaacttatagaatgggagaacaagttactgcaccgtcatttagatatgtaacacctgcgatgatgaatttcatgaaaaccgctagtgtagcagtagaccaagccgcttttgatgcagctgtgacaacatacaaaacccatgtctctgggctagtaaatcacgttgttaccgggcgacctaacgcaacttctgttgacccaggtatcttaagactgtctagatctaccactggtgctggtgtgactactaccaattattatcctatgtttgacataggtaaaggtgctttaagccaagaagatatcggattccttaacagtgtgtttgcacgagtatcagcctctacaggcttagcttcgctaaacaaccaaaaagaaggtaattctcaatctcaccatgacgttgacatgtgtgacgcctttaataatcatttgttagctgtgagtaccctttctgtgttcccaagtgtggttagtggagtttcgacccatgtatcacctgacggatacaattctgtagtttacgcgtcagagagaaagtctgaggacgttctcttcaaagcaactcaattccaagctgagaaattcactggttcaggtcatctgctgtatcgcacagatccggctggcatgaatcgttggacacgcgtgtatttagatgaagtagatcgtaatactaacctagagcaatcgtcagatctgacattccaggttaagaactcttgggctcaagtcggcaacgatacacagcctcttgtacaggacaattacgtaacgaaagtctttagaaatgaagcgaatactagttacctttcggtaaataatgtagactcaacgtctgcggcaaagtggttcataactttgagtgaccttatggagaaacaatacgattgtggtattgatttattaatgtaatgtcattggttaattttctagacctagtctagaaggttaacccc

SEQ ID NO: 681 - DNA, 2010 bp, Unknown
  derived from dsRNAs of unknown virus
gaatattatagtcttatctatgtcatatcatgaatattaatttctattcaacgtacagtgttggtgttaaaacacgactacttggaagaaaattacttcgaactagggcgcgcgcggcattaggttcatttgtaattggcaatgccaaaacgaatatcgatccgaacgcgctgctactacgaaaggatagtgcacgcatattcatagtggacgcaaatgattttaaagatctaatgcgtagtatgaaatatagcgcagaaaaagccattgcctattatgaagcggtaacccaaataccgcatacagttaggaatttatatgcatataccaacaagaaacataaacctccatccagtggatcatcaggtataaggcgtatgccaaaattaacttggttttctaacacatgggataagcattcgtgggttcgcaatatgacgaaagaaaatggtggatacccatgcttctggaccaaggaccatagtgcaatcacggacccattcagtaaggcatggaaactatatgatgctaaattcccagataggggatggaggataacttatgacctacacaccgatatagatgcggtatttgctgagttaacaagtttcattgaaatgcatcaagaagaggaagaactccacgtttggatacaaggctcgttgaatggttcagatccttcaatggttataactgacttaaagaagctaatttccggattaaccttaaattcttcgcatgtaagtgaggatgttaaagtgatcctgatgccttcaggttcaggaaaaacattttactcaagaatgtttgaacatgtgatagatatcgatgacatatacaatggagcaacttcgatgcaaaaacgtaagaggaaagaaacaatggaatctgagtcctggtcagtgcataacgaagtgaatgcagaaataattcatagattttatgaagatggtggtttaaataacaaacttctgttgactcatggcgaggactcgttacgcaagataccatacgaaatcgtcggtaaatacaaagtgccaatgagtgagctagcaagtgtgttagaggaaaggtcagacgatcctttccacgtaaaaatgactaaattaaattggtccacctcgaattatagcattaagaaccgtgatgaaataaaagacctaattcactatcacgcagcgaatataaatactgataatgaattaaaggttgacgtgcgaagtactgaatacacgtctctttgggatacaccaattgagaaatcttatgacctgtgggagatgtatggttcaaaaacgccaacacgtattcctgtaattccatggcgagtgagtaacttgggaccaaggatatataaaaatggattgccaccacaactattcccaaacacaactatcatgaagaggctaaacatatcattagatggtttgaacacgactgaaatttatggaaactatagtgaattcgtaacgcttagcgcagtgagtgaatctgatgtaaagactttagactttggatggcgcgctgttggcaacaatctgtatgcaatgtctgaaatatctgaagaaaattacgcagaattatataaagttgaagacataaaattctttatgggatgtggctcagtaataacagctgcacatgcatgctttggattgggaaggtcaaatgatgagttattatttcaactggaaaggaagatgaatactggtcatggcacatctggtcatatgatcgcaagtgtattagctttccaaagtcattttctgtggtatttagaagaagtatttgaaaatttccatagtggtaagagtgtttacgtaaccaagttcaatgaaccaggatctggtgcgtaccacacgatacatgaatatagaaatgcgatacatgatatgaaacgatctgatacaaataagttatatccgggatatgctagaaacaatctaggaatatgcgagaaatttgtcagtaatctaaaaatataggagggaataaggctatatgaacatc

SEQ ID NO: 682 - DNA, 2009 bp, Unknown
  derived from dsRNAs of unknown virus
agataaataatcttatgaaacaaataacaaaataaactcgtaatatgactttttgtttatttatctttacgagtcagcaatgaagaagtaaaatatgaaaaataaggctaattctcacttccgacgtcttcacaagagatccggtttatcaagggttatataccgtgagactaaaaataactttgttgatgctatttttaaatcaggtttaaagattggttctgatgaacttgaagtgcctttaaaggttaaaggaacgaatcttatcatagtcccttctaatatttactttggatctaatccaactctgttaccctactatatctatgataaagaatctctagaaagattacgtagacacgtttctagggtagcaaggggctcttctgtggattttaagtctccctttgttttcctcattaataaggtaatcggtaccaaagatgaggattgcaacactaggaggccgataatagaattctttcgagaatatgttcaggatagtccaaccattgttgatagtcactcactgcttaaaagagagtttttagagcttgaaaaaattggtactacctctatctctttaccttggcgttacataactgacgatggtagagggaaaagagttaatgccatacaatattactcgcacaaaaagacctcaatagatttcgaatcgttacgaaaggcgattgaaaatgtaaagcgtaaggttgcagtggagagacccttatcaaggatttctcttaaagacgctttagatagatctgttaaaactacaaactggggaccccctttctggctacgtggcaatgagattttagatggcaagcgtgttgccgactatcattactccattgctgtcctattagagtcaaggaaactaccattcttcaaggcactggcagtgctggtagaaagggttcaaccaaatggtacagacgaaccaaagcagcgagcggcgatggcttttcctcattatataacgctattagaaagtacgtttcaagtcccgctattgaatcatctccgaaagtttgagggatttgaggagtatgttagtagaccagcggcgaatgagaaaataactaagatgctattaagagctactgaatttcttcttattcttggatttgacggtgaatcttttgatactaacataattagagagctattagacggtgcttatgatatcgttgcttctctatttccagtagaagaccgttggctaatcgaagagctaaagcttcaaaatattgaggctgactggctgacgcctgacggtatatttactggtcgtgttgatggtatgtcttcaggatgtgcgttgactaatattattgacactcttgtacaatacatcatgattgagtactgctcaattagacatggacacactgaacttgaaaataaccaaattctgaaaataatgaatggcgacgatggtaattggcagttacctaatgtcagaaaatcagacatggttacttattgtgcagagcttggcatgcctattaatttttcaaaagcccttgaagaaacattatttaccgagttttgccagcgttactatgagcttacatcagaattcattgataggaatggaatttgtaaggatgtaagatcactttgtagaacgttaaattcaattctctctttcgagagaaaaccagatccagagttcaaaagtggattttatagtttaagagtcattggacaactagaagaatgtgccaataacccattgttcaatgaatttgtttcattcctagttaattgtgataaagacaatggacttggaacgaaatattttggtggaacttccaatttcatcaggtcactttcaagaggtggcttcggagcatatgagaacttagcagttatggaaagagccaacagttatgacttagagaaggctaggggtctagatgacaagatcatttctcttcgagttgttaatttattagacaagactgggaggtaagaaaagggggttcctagcccctcct

SEQ ID NO: 683 - DNA, 1969 bp, Unknown
  derived from dsRNAs of unknown virus
ggatttattcctttgttggagatacaatgagtgtggcacgtaatctatctcgctcgagttcagacgaacgattgaaactactattacaaatttgcgatgtaaaagaattataccgtaataatgataaagcagcactacgagacattgcatctgtcgttggtggagatatagatcacatagattcctttgttattcaggtgaagtcatggttgaaagaatttaaggaagctgtcagtactattgcactatcaagtggattccggtcaacaggacttaccgcagcacttactcacccttcattcctaacctcgtcaggtggggcatcgaatggcattatttttgatgaattaactgattttaacgatccgacaggtgtgctggcaggagcgattacaattgttgaagaaaaagtttctcaattgacttcagtatcaggtgtgtccacaaaaagtcagcttagggcacagaatttttctcgaatgagtgctattgaaaatgaattgtctcccattgctgaaagacatgatcagcatcaaattggtaccaaatctgtaaagggagggtgtgttattcgagatggtgctgctaatcaagtaatcccatatacccaaacacataacgaggttctacgggatacgcacgatctaaggagtacgattgtgggtccacggtttgttacaactaatgtgaaggaatcagatgacgtacgactggaagtgatgggaggattgtcatcattcagtacgtcagccgatgcagcgaaaacaaagttggtcacggcgagatacgtgattgtgggagtggctgatcgaacaattggagcagtaccagcaggttctttgggtggatttggagctgaggcgaattttttccatggtgctaagaacagggcgacggatacaggagtgtgtctgatctcagatacagaccttgcgaaattgcagtctggtcctgtcatctttggatctggtggagttccagggcctagacgtattgttagcgacaggatgccaggaggtagggatgataatgcattttatggattgaaagacaatgagattgtaattatccctctttctggattggacgatgttcttactaatgttagtggcgttccgtatgataatggtgacgtgacgcagatgacgttgaatcatattcaggatattaattcgcccctttcagatttcatggagacctcgggtacttataacactatttcattgaacagatacatgaaactagctaaaaaggtgcttcctactacaaattttgatactgtaatggtgatggatatggtttccgtcattgatgcaggtggaatggtagctggattaggtgctgcagtaggtgtagcagcaggatctggtactggtggtctggttgagatgagtatcacaggttccatcgcagctgcttcggttggagaaagtctgcttgcagtcgtttcatctgattcggttactgaaaatgtacgaacgatgcgacgtgcttgggatgatagcaagatcattcgcttggtgagtggatttgatgcatatgcttcgcgcacaggtgatgccccagtggtaactcgtgcgcttagtgaactaattagtggtgcataccgtaatacaccatacattctaaatgatgttttcaagcaaacgcttattgaccatgaaggtttggctgctgctccgacaaccgatcaggtatttgaaaagcttcaaaatagcgcaattacgggtacatacgcggatgggctggatgctagtatgtggattggaccgaatgacgcggctagtagaatgaaaccactgactgacgacgggaagaatggtatattcaagaaatggatgagaactttggattacattacattgattgcacttatgactattgattatgcagactcgcagcgggattaatttcatgtcacatgaattacgcaacactacctccaattaaacactggaatttgactacc

SEQ ID NO: 684 - DNA, 1963 bp, Unknown
  derived from dsRNAs of unknown virus
gaattatatctagcaacatacacaatttaattgaataatacaaaaatgagtggaagaggtggcggaatcaaagttaaaagaaagtttaagacaaaaccgaagaaggatcatgcaatgccagcattgctacagccgaggtcacgtttcgatgcgccagacacagtgaataaaactgctcatgattccattgaaaacatgcttaatacaatagctcaaccaacgttgaacgttgagaatccagttccagttcagcctgaagcacaagattcagtaattcaacgtactattccaattgaaataaatagtgtgaagtatttaaatcaacgtgatgtacgtattcaaatgttggcaaacacactcatgagtggacatgtcggttcaccctggagtgaaaatccacttgaggtggcaaatcaaattgcatcattagcaagtcatctcaaaagcatgtattcacaagacagatttgcagctaaagcgaggtcagttcaagcaagacaagctttaggaagaagagttggaagagttgcttctgcaacacacttttcattaattagtgatggcgaaaacgatgactttgcagatcaattatctagattacgtgttacagatctattcagaggcatgatggatcaaatggttgatagactcgatccagatgatgtttcgagtcaatctgatgatgaacgtagccttcctgatatgccggagttaactttggaaccatcaggcaggccgcctatggcattcttaacacagcccatagcattcgaggtgaatccctttaaagctgcagaatctgataatgaatcaattgaacatgaatcaaggcctgcagaaagagcacttatggaggcgcttaatgatagcgaaaatagttcggatgataattcttcacaactttcgatccttgacatgattggagtcgatgatgcatccgaaatcaagaatgaagtgcatggtacgttaacaggcccaggtggattacaaatcaatgtgaatgaaacacatgcaacgcatgcagacgatggatttgaacatgttgataaatcatcatctgatcatcaacatacatttactatggaaggtaaaaatatcaaggtacgcatttatagcattgaggaactcaaagctttaattagagctgagaaagagcttagaaatgcagaaaaggcttatgctactgcaatcactaatccgttaacagaacatgagcaattgatagaaatccttgaattatttgttgttcctggagccaacgagaatttggatccaaatagacttagggtaaatgacctcatgcgttatttaacacaaaatgcaagaatgcaagacagagggagtgttcctgaagcctataatgatgtaatcattaacatgtcagacaatgatggcagaaaaacagaagttggtgcattcattagcaacttctcaagtgctgttgaggaaatcgtagaagtcattaaagagaacggtctgcgtaagattggatcgttaaatgacaaaatgattgacacaataattgctcgtcatcaaagaactaaacccgctaattctttatacacatctacacttaccggtgaaattattcgaatgaataaaattgtgcaatgtaactatgatccgattcatttacactcattattcaaaacgccattaagcgacgctgcgaaacgaatttatggggagtggatcaaaagaaaacgttcattaacaacaaatcagttgattaaaataactgaaacctattataagataaatccaagacaggttggcgttggtacatttcttgatagagatttgcgtgctccatttgataaaggaccatcctttagcagtttaaatgcaatggcgcaaatgatgactgatgtcaggcaagaaaatatcgacgtgcttgttcaaattctccaacgaaaggttaaggtttaactgaagtatgatgaatggctagatgtaaaagctc

SEQ ID NO: 685 - DNA, 1836 bp, Unknown
  derived from dsRNAs of unknown virus
gtttaaaaacaaaaattgattaaattcaataaaggaaattctatatgaaatttcgattgtaaaatgctattatgcattttcaatgcataggtgtacttaactttctagcagctaggtataactagtgaaacaccatcattaactaatttattactagttaaaattatatttattcaagaggagaatatttatgcaacccattttcaagggtaacacaggacaaatgatcgacgcaggtcaaagagtcatacgtgatttgaacgcaggtaacgctacttacggttcaatgattgacgaagtgactggggtaggactggaaatgctcccaccacagtactcagttccagcaaagaccgcgctgaaactaattaaagctaaagacaatcaaaatcaaacacaacgaactcaaactcaaacgagttctaaaacaaagtcaaacggcaaacagtctaagtcaggtaaaggtaaaggctctggttcaggtagaccggagtataactcatcgcaacctactccacaacctggaagaagtaactcttcttttggtagagttgataaaggatcgagagttaacctaagttcagcaatggaccaatctacttacaagataccttctaaaattcagaaagaaacatctgaagaacagaactcgaaaacatggcttcaaatgattgcgattactccagcatcaatgtacgatgttgataataatccgcaaattacagttgctctcgattccatctactacaaaaatcgtagctctgtgatcgataaaactcgaggaggtaccggtagtacggcgattaatcttactaaagcaaactggctcaattacattaaacatgtaacttcgggtgtagctatgctaagtgagtactactcaataagaacaatgaacccgtatggagatgaaaccaatacgtgtttaagtagtatgaaagatgccctaaacagtgctagtgattgtatgatcgcagcatatcgtttagatacgcttatttcagaattatgcatcccgccttatatattaacatactaccaatggctgtttcaaacctataagaagtctcccgttacaggtggagtacagcaacgatttatgtcaacgccaatgctaaaagattattatgaagatgataaaactttcgcgcgcgtgacctctgaaatggacgctgtgtcagattttattttagataatgagtattttgctaccattacttctttaatgactcaaatgacagattacgattggattatgcttgacagaagcaaagtcggtggctgtgaagttgaatacgactatcatgctaacgctatcttagataattctccaattcgttttcttactgacgccggaacagtacaagtaaatattaacaaattcctcggactagcagccgatgataacacaatgctgtcagctttccctatggataagctcaacgtacctatttcagttacttctgctttactattaagttttggtacctcagaaacattctgtggtttccctttcttcaaagttggtaacaatgatttaggtgacattaatgcaaacggttatattgttgttaatgatactagtaaagacgtaggagtagcgcttaattcgtgtaactctcctgaacgtcaaatcaatgacacaaactggctgataaatgatggacgaactgatgctacattccttcctcgaggcatgaacacgcaacagtacgctctgaactatgtttcgttatcagatgcaactcaagagttcttacttgatgcatttggagtacaacgataattatcagattaacgggagtgagcattctatttatagaatgttcctccccc

SEQ ID NO: 686 - DNA, 1934 bp, Unknown
  derived from dsRNAs of unknown virus
gttttaaatacaaaaccgtgccctcagtcaacgaaaaactgttaaaatttgaattttaaaattcaaataaaataatcataattattatcaatgaaactaattaatttcaagtcaaaccacagacgtttgacaattagtcatttccgaccgtcccccggatacagaaatataaatagatttggtatggataaccaaaacaaggacattttagacccagctcttagacgcgtcgctgaaggcgaattcgctaacgttcgaaatcgagtttctcaaaactcaccgcgaggagcaaaagtgttagaccaattaagtaaaggtgacacacaaggagcagcacaaactgctgtcgaaatgggcgcagacggagccatcaattatgcctctcgagctgcacaacgtttagctactaaagctagaacacgtgtgaaaactaagacatctacaaaacaggaaaaaccgaaacaacctactatgacacgaaacagaaacggaaataataatggtggaggaagaggaaacaaaagtggacgaggtccatctagatactctgctccgagtactagtcctagacaagatcagggatacaatccattcatagatccgccatctagttcaccaatcaaaaactcatatccagagtttaaatcattttatcacgtaccactactttcacaagagatacgagaagatgatggtgagatagtcaattacgccaagactgcgatcacagtaatcaatacagatgtttcgaacttgttcaatatccaatctccatctctgacagcgtcagatttaaagcctcttaacaatgctaagagtcgcatttacacagaagcaaaaattcaagcgatttctaatactaatggaggaagatcagcatcagtcacattcactagcgatagattctatgagtatttacgattaggaatgtcagcatgtgctctgattgctaacttaaatgcccttatggcatgggatccaccgtacgaagaatctaactcatgtattagatctctaagtaacaagatgtcatcatcaattccactacgtgttgcgaagggtgctttagaagaggcattagctgccttagcactacctcgcccaatgaaagagtactatcgagaactgttccagatatacaaaacctctcctattgcaggcggtactcatcatttattttgtaatcatcaaattataagagatattaaaaatcagagcgttgactttgattcaaccgttgcgcatctcgataacatatcagcgcagataaacggttcgaatttcaatgattatgctgtaattacggctcttcttaaagataagacctatttcacatatgactcaatgcgagacttgattgcgatgccggattcgccgtgttactcagcacgtcaagcaactctctttaataacacaccatggtatactacgacaaatgctactccacctatctcattacctgtattctcaggcggattagatagcaacgatacagcacaccttgtgtcagcaatgggtgttgacgaacttacctgttacgaagttgcaccagctattcaattatttggtgactcaacaactggttcaggtccagtttactttgcatttgaattcactcgagacccagatttagatcactctaaccgattctggtttaaagactcgaatagtccattagaaatagaacttcataatgtgattcaatcctctgatgatcttctagatttcagagttacaccacaagctactagtattgatgcgtcgtctcaagactacaatccaatagttgttgctaaaggtgaaaacgttcgtctataccaagcttcaaaacaacctttgattgaagctactgtcaacatgatgtacaaaacgatggatatatcgtcaagtaaattaatgtaaaacgggggaggatatacttagtatatcttccc

SEQ ID NO: 687 - DNA, 1926 bp, Unknown
  derived from dsRNAs of unknown virus
gttttaaatataacaaatacgccgagaggcattaagctcttatagagaatatttagttgaaatccatatctgacggaaaacagatcaaccgtcgtaaggacgaaaccaacaactaactaaccaaattaaacaaaatattatggttaacaactggacaaacaaacccttgaaaaacttagggtctggaattgaacaagccggtagccgtttaggtagtaccgcaggtgaatttatcactgggacatcgttgcctggtgaaagcaacccactattaaacccaattatgcaaatgggaaaaggtgttgcagcaggtgcggcagagaacttgattaatcaaggagccgaccgtttatccaataggattaagaatataaacgaaaaaggtaatatgaagaataattacaaaggcaaaggaaaaccgaaatctaacaatagatcgaagaataattcgagcagaagaaacggatctaataataacggatccggtgcattcggcccaagatttaactctaatcatggcggtggtggaggtgaaccttcaaaatatggttactctggtagaaccagcgactcatcaaactatgctccgtttaatttaggacctgtaggtgatcctaaactcgggggatacatgaaagtcggaactccatattgtaacaagtttcactcgcagttcatccataccggatcaatacatgataacgctaattacctccgtaacacgtttacattgataaacttagattacgaccaactattctgcacctctaatagtgacaattataatataagtccaattgacacggccctttacaaaattgtaaatcagtacagaatggcaatcctttctggaactggaggaagtaaggccgctgactcagtcacgatggaatcgatgactttatacttccaatatacccagtcattacttgcatacatgatagcgttgactgctatcatcaactgggacccaccttacgcggaacagaattctgtttttcgaaaattgcagattatctattccaataatgtggagttacgtaaaacaatggcagaagctcaagacttactacaccaatactgtcttccacgtggtgtaattgagtattacagacgcctctttactgtaacaaaaataagtagtttagagggtggcgtgcatcatatgttcattcctgaatgtttcattagtgcacttcaagccacagataatgacttatctgtcgttatcaatactttaaacagcttagtcagtgcaatcaaaacgaatagtctaactagtactaatgactttccccgcattactacgttattgttagacaaaacccctttcgacttcgtttcattacgaacagcgatccctatgccggatcgtcctattcgagacatcaaccagatcactctcattaacaatggagcttggtctgcgtcaccagctgtaatcacaacggacaatgacgacgggatcttacgaggaaattataattatgattccaaagattgtcaaatgatatccgctgtggagccagatgaaatagagacttatgaatacgcacccctaattggtgtattccatgacgaacatcatcttttcccaatgtggaattatagtaaggttatcacaacgttttctaatcgcatttaccttcaagaaaatccaaacaacacgacttatggaatggatgtattaccaattcttttcgcatacgaagatcctcttgacttcattgcggtaacgcgaactatgcacgtttcaccaaccggcgagcacactgcaaaagtgtacaattcagctagaggagagaatgttagactatttgatctaacaatcgagcctgtaattgaagcgaacgttaacttattgaatcagttatatgatgtaagacaagtttaacatagcaggggttattcgttagaataactcct

SEQ ID NO: 688 - DNA, 1867 bp, Unknown
  derived from dsRNAs of unknown virus
gaatcatattccacacactatgcaatcaccagacatcatccaatcaaatgcggttgatacatatgacgcggccactctcaaatatgtattcgagctctcacactcaacaccaagagtcaaaacgttaatggcgcggagtgaaatacccgtgaacacgctgaccgacaatgaaggagtgtttacttatgaatgctcttaagcagttcgtttatacctgcgtgatgtccaacgcatccttcatgtcggcgcgttttccggaaacgcaaaaactgcaatttacggatagcaaacgctaccatgatgcaatgatcaccgagatgagcgcgaaggaagacatgtcaaccaaccctactgggaggcgccaggcatatgcagagcttgtgcgcagcgacgtgtgcatggacatgaggatattgatgaagcacgtgcagtaccagctaacccaaacacaaatggcggacctggcaggtgaacgggcgtttgaagtcatgcaatactgcatgggaaaagacgcaccctactctggtagcgttcaacctcaagccacaccagatgccaacgtagtcaacggatataaattctatccaaacataaatcactcagtgttgggtggagcgcaaaccactaactcaataaccgtaatcttccccacatcagtggaaggaagtaaagcggtaagaataacgaccgaagcgattatcagtgagtcacccacaggtagccaggtgctaatggacttcacactgtccctattcccgaaactgccaaatcacatgaacattattaatgcagtcagcaaaacgacaacccacgtatgcctgattgaaattagcgccaacacagtcactgaacgtgtagtatacttttacacgttcaacagaactcgcggctctactcttcacggcgacgaggcagtgttcatttcactcaacatacagttatataacaatgtacatggtgtattcgaccatagccgcgtgttactaagccaacaatacgacgtattactgagagcggcgatggctcaacacaccacagtcaccgtgacaaaggtaggaggtagaaagtttccagaacttgctcagctacaaaagatcaagtttacagcggacagaatgcttagcaatatcgctattgggggtaacgaagcgtataatcaggacaaaatgggtattgaggtggtagatgcaatcgcgcgattcgcgcgtagcgagatgattggtgagggtcaaattgatgagactctcgctaatagactgaaaactgccactcatctgcgtgaacgtcacatagactacatggcatacgccacaaacagtgattacttctcatcaccacaagctgctgacagtcctgtagccatgcccaccatatatgcagtgtcatcacacaaaaagagcatgggaggccttgaagttttcgacaacataagcgatacgaatataatccccgtattcacagtagattcgtgcgttaagagcttagacatgcacaaacatattgatgccataatcaagggaggacgttttaatatgaatgactcctcggggcaaactctgcaacaacaagtgttcatgcatcatgtcgacattcttaaaagcaagaatttgctattcattgacgccctgttgtcaaaagcggcaatcatccgttataaatactttgagtcatcatatgctctagcagtcgcaaatacgctacatttcgctaacaatgatcatgaaaaatacattaagcagagggctgacctcgtcagaatagtaacaagcgcatacaatggaagatacggtgtagaaaaggcggaggattgacaatctaatctgtcgttcacatagggaggcgctattaactcctgggatataacatc

SEQ ID NO: 689 - DNA, 1758 bp, Unknown
  derived from dsRNAs of unknown virus
gttttaaaatatcaaagccgtttaatagtaacgaaaaactatataaattttatttaatattgttatgaaatatagtataacaaaaatatcacaagacaacgctgattcattcttcacaaaagaaggattagagagagcttctgctgtgttttctcggatacgcttcggacaaaaaccaactccacgtacgccattgtacaaagatgtcccagaagacgaagtcttcgaaatgtgggttgagcaattggaccgtattctagaggtatcaaataaaagccctaatgacgaaggttatttaggagatctaatacagtatgacaagtctagaacggtgaaagtcggaccacaaggcgaactgaaaccactggatgatcgtatggatgacatactacagtattggacattaccaattaatatcgatagagacatcgatatggacatcattgacaacgtgagaaacatccttttcggaattgatccatccgggaaacgcaatttaattagacctatgtcagtcgagcgtgttgtctccctagacaagtacgataataaacttgtaacaaattcaggatgcccagatttcggcaaaagaaacgaccccgcaatattgagtcgagctatgtctgatgcagaacttggaatctggaagaactacccaatggcgcttggtgcaagatcgcaacgaggtaaagagagatctatcttcatggcacccttttccttaaatatcaaggagaagcaatttctatatccgcttcttgaaattattcggaatagaaatataccgttcttttcagcctgggagggatttaaacaagtcgaactaggtttcgctgaacaaaatttctttaataatgaagagagcttattaatccaacaggattacacatcaatggataagttctataatgagacgtgcaacgacatagttaaacttgtgtgctcatccgtctttcaagagaactacagagatgactttaatgaggtagtagaccacttaactacggtacccgtcctaatatcaactgacaaaatgattgaaggtcgtcacggaatgccaagtggatccggtttcactaatttcaacgaaagtattgtttcatactactactctcattggttgaataaatataaattaaatgtaaatgcatctcaaggcttaggtgacgacttagcatttgaagttccaacaactacaagtcaatccaatgataacgaagattattcagatatagcgcagttactttctacctcttcggaacaagcagctggtttagtagtagagcctactaagcaacgaattgataggaaaactacagtttacttacaacgattcttcgataaacgtattcgggaatacgacgaaggaatggaaattgttgtaggatgttatcccagtatattagctctaaatactgcgataaatcccgagcgataccacgatccgcgaaaatggagtggcgagatggagacacttcgctggcttatgattctagaaaattgttacagattgccgtactttccagaattagtagccttctttgtaaagggagataagttcaaattagggcttaatatcccaggattcttcgataagttacccattattttcgatgaagccaaggccatcaaaggtttcgtacctacatacaatcaagaaagtatggataaaggtattttagattttaacgttgttaaatatctacttagaaatcgctctgagctagagtaaggttaagggatggatctccatccccc

SEQ ID NO: 690 - DNA, 1829 bp, Unknown
  derived from dsRNAs of unknown virus
gggaatttaaaagcctccattaaggttgacccaagttgttcatctaagaacatctaaatcccccgtaagtactcgacgtcacagatactaaaacaaccccttttatttatttattatgaccagaatatctacttcagacgttcgttccagttttaatcaacttaaattcagggtttctactttagaatccttatcattctttaaggtttctcactctataagctctaacaagcttaagtcagcggcttctcgtgtcaatactcctcttccttttaaaccttttgtagatttaatagagaattcacttaatgtgaaatttccagagaatcttgcgtttacacctgaggaagttcgtaaacgagacattgatcaaattgctgcttaccaaactgattacgacgctttatctaatatcaattttgactacttcttaattgcttgtttagaggcgtacaaatcactaggtttagacagacaagatgtttttcatcttacatctgtcgaacagtccgcatcatcatatattaagagtactagtgcaggatatcctacatttcgtaagaagggaagtcaatctgccattaaagatgctatatcttttaccaacagttttatttcaagcccttctttgccaaagataatgagagggtgtccttgcgctgtattccaccgttaccagtataacataccggtttcggaaactcctaaaagcactacaccagtctactcgaaagaaattatccaagacgggttaagtaatattataaagaagtcccgacaagtttggggcgaatcttttcgttatctaactctatcagctgtatattttcgatcttttgtagacgaaactacaatttggaatagacaacaagaagtaccaactactacttatggtctcactaaacgtgaaatctctgagcgtatcatatctcgcttgagatcatctaaaagagacattatctcagtagacttctcaaaattcgattccactgtacctcgcatatttcatttaatgttttatgcacttcacttggcgcatcattcttacatgctctgccctaagatagtcagtttaattgtagtccattcaattcgtacaccattctgttacggttcctctgaacttaagttccatgagagaggtatcgcctctggcgagctacttacctctttatttggatcttttgttaataaagctattatcaatttagcttatttagaagcaaccaatggcaaacgcactgctcaaacggatgcaatatctttaggagatgaccttacttacctttcaggtatagtatccttgagtcatttcagaagtttatgctcccgtttaggaatgaacgtggacctagagtcttgtttcacatgccactctgacgaacccttccctttcttggggtatatatgggatcgtgagaacaggcctacgcaactcgttcagtggtatattgcgcattttgtaattccgtcaggttttattcgcaaccgtgctatacctattaagttactccaaacgtaccgtgccatttctgttgccatgcaattatatcatggaatggacatatatgttaaattaataggctatggagacacagtctataggagtttactttatgactacaaactaagcggaaaggacccaattatattatatgaaggtcctgactctagacaagtaggtattggttttcctttatctactattttaaacatagggtgggaagctttttagccgacactcgaatactacagttctctaactcttctagttaggtactgttaatacttatattactttaattagtaattatggggggctggtaccc

SEQ ID NO: 691 - DNA, 1809 bp, Unknown; identical to SEQ ID NO: 430
  derived from dsRNAs of unknown virus

SEQ ID NO: 692 - DNA, 1799 bp, Unknown
  derived from dsRNAs of unknown virus
gaatattattgtaatcaagcaatattgtttcagccaaatgagtagaaatttgacgaaacgtagtatcacggatggtggcactgcagagcgaagttcggtaaaaccaccaaatgcgactcctcaaaaccaatccggtggaacgagaggcagaaatctgataaagcgatcaacctttggcggcactgataactataccggtacggatgtgtacggtgttgttcacacaaaagcttctccatcagccttagacgctattctaactgcgtcaatgaacagaaagcgtgatgaagttgaatcaaagagaaagcgtgatgaagtggaagcaaagaggcgtgaggaagagaggaaggcgcaagaagaagcggagcgaaaggggcaaccagaagagcaacaagaagaggaagcggagcaaaaggagcaacaagaagaggaggaaaagaggcaaccagaagaggaggaagaggaggataggagaacagctgaagactataagagacagtgggatgagtggcaggcgtatcgattggaacttgagcagcaatgggcagatatggactatggtgacaggcaaggtggaatagacttcggagatgatctgcccgatgggatcggtcctgatccggaaccatcagagccatcagatgaagacagatggaatccattcagtcgggcatcattggagggtgttcatgagatgcatatgtcattactaactgcagataatgctgagagtttttctgatgtcatgcgatattacgaaaataaaacatacgaagttggtggagtactcgcaatgccgtttttggataaattcgtacgcaaactaactggcagtgaaaaggtcgcaaagaaatttggtaagacacgcacaaagctttttaaaagagcagctgtagccatgatcatagcggatatgtcacgcgcaattcgtactggggatccgtatgaggtactaccgagatttgaaactggctcccccttcggtataggtgaagatggtgaatatgtttcaatgccatatctcgataggctgttaaggtcagttaacgttgtcggagccatctcacgtggtgaaccaatgacaataggagatcttcccggaatgggtgacgtatcgcaggacggcgaaagtgaggatttctttccaggtatggcaaacgcaatcggaaatatcctcgaaggtatagaacctggacaggtatcggttggaggtatgctacctttccaagcactaactgaatttgaatcgcattcagaaagaatcaagtctatttttggtataagagtaattgaatcggataggtactatacagtaatgtatgatccaagagcgaaaataacgtacatcgaatggaagccgactgaagacatacgaaacatcacaaaagggaatagaatgggttcagtgggaagagaatggactgaggacgccgtggcggcaatgggcttcaaaataccagcatggtcaaagcgagtaaaatacataaagaataaatacggagtggaaagcgaatcagtaaaacattatggatactctcgtggagctggtatagccacacatatgggtggccttggatatggaaccggttacttttcatcatacatgccggacaaacgttcaacctcaaagctgagtggtgatgcgcttcatgattatgtaattaatccattatcatacgccgtaatgttgaggaacgtgcttcgtcagtgacaatcaacaagattcactaaaagaatcataatgctgaaaacgttatattctagctataacgaatgcgtgattaccatatgaaaacatc

SEQ ID NO: 693 - DNA, 1688 bp, Unknown
  derived from dsRNAs of unknown virus
gtttaaaattctttaaataccaattaattcattattaaattcttatatagttcacatgaaaactacaaaactaatgcaagaatctattgaccgcttcctatcgagcgaaggtcaattacgtgcttccaatggttttaccactcttgctgttggtagaccacctaccccaagaactcctttatacaaagacactccacccgatcaggtactggagaattggtgtaaaatcttggaccaagtagaggttgagaataagatcctggaacctctcattcaatacgataaatctaggaaagcgaaattcggtccgcagggcggtttacgaccttggaatgaacgtgaagaggacttcaaatcttactatgactcaccaattgcggctgaggattataagtcaggactgaatgaagatgtcattctcgattgtcgagatatatgcttcggcacgcaagctatgcaaaataagcgtccagtcacagtagaaaaagttgtgtcgcaggacatctatgatgacaaactgaactcagtttcaggctgttatgactatgccaagcgtgatgatccgagtgtcatcgccagagctatctacgacgtagcaaatggaatttgggaaagatatcctatgatccttggttcacgctcccaacgtggttctgagagatttatttttatagcacctttctcattaaatctagttgaaaagacatttctctatcctctcatggagcgcatacgatccgtaggcgatcctttcttctctgcctgggaaggatttagtcaagttgaacaaggtttcaaagacgataactttttcagtgaggaaaacacatacattcaacaagattttactaagatggaccgtcatgttaaccgcaaacagatgcatatcgtcgcggaaatctgtgctaagttttggcagctcagttttgcgcaaaagttctccgaattgctacagtttattctagacatcccagttttgatctccctggacaagctggttaccggtacacacgggatgccttcgggttctggaatgactaactttgcggaatcattgattagtttgtacctaatcttaacatactcttataacggactagaagtcgttgcatttcagggtctcggtgatgatggtgtcattgcgatccgacgaaacggtatggatgattcagagatattcgccgttatggaagctggtgctaaggagattggacaaattctaaatcctgaaaagcaaggtatcagtgaccacacaacaatttacctacagagattctttgatgatcgaattcccaatcaaggaatggtcttaggaatgtatcccagtgtattggctcttaacactgcgatatatccagaacgttttcacgacgctcgcaaatggagtaaagagatggaaatactccgatggattatgatcttagaaaactgtaagaatctcccttactttagaaagctaatccaattctttattgaaggtgacaagtataagttaggacttgctctaccaggcttcttcacacagttaccacccttgtatgaagagtcaaaggctattaaaggtttcgttcctacctacaaccaagaaagtatggatcgaggaatatatcaatttgaaactgtgaaaatcctcttagaaatggcgagtcaacgctgaatgcccgggtcatgatttccatcatggccac

SEQ ID NO: 694 - DNA, 1746 bp, Unknown; identical to SEQ ID NO: 452
  derived from dsRNAs of unknown virus

SEQ ID NO: 695 - DNA, 1762 bp, Unknown
  derived from dsRNAs of unknown virus
gtaaaataaataaaactaaataaattccttaaaattcttttaaataactctgccacccgtactatcaggttaatttacaattattcagagagtagagaaacagctaactttacaaacattcaaatacatgactagaactagtgtagttaagatgtatgtgccaatgcttccaggtagaccaggtactgttactagacctgcgattagtcctcagacgctacctcagactcagcttgacccctcaatgggtaacggcaaccgtgcacaaattagaacaaacaacagtaatgcgaacgcaccgagtaatcgccctaatgaattaccttcgggtaacagaattggaggccgatttccaaatcgtcagcagcgcagaaacaacaataattcgagaccagtggttcctatcatgcgcgaaagaggcggtagaaacaataattccaacttgaaggtagtagccggagattttggttttaacattgatggatcgaatagtcccaatgtctacacaggacattctgagacgactttattccgtgactacaacaagaattcagttaaggtagaaaatactggcttaaacgagaacaatcttacaaatgcttttaaagtattaaatattgatttcgcacagtctattcttaccggaggttattcagacgcttacaaagtgattcgaaataagctcgaaagaacgattattagttcgacaaacgcatcaagaggtgcgatggacattatccaagcccaaaatatctctctttatttagactcagttgtcaaggctttcgacattcttatagaattagaggttatgcaagcttgggatcctgattcaaatcagtcctacgacaaaactcttcgtacattagcatcgaaagtttcaattgcagaagtacttgagtaccgtaacaagatccgaatggctcttattccacatgtcctaccactaggatggatgcagtacatcaaatggctccgtgaaactcatcttcaaaacgaagtagctgagtctacaaaactgagatttgtcagcactgtaacagtgtctgcaatggatgacgccctacaaggaaaagaattctccacttggacttggaagtcccgtgttgatgcaatccttacagatctaaataatcaggacccacgaattccggccttaattatggccaaagtcgaagatccggactttagtttccaaaacgtgaaagatcactacactctagttcacaatagtgctagttatgatcctaacttcaacgatttatataacaatcgtacaattctatggggtacaggaactactacaagcagctatcctaagttaactggaacgcagaacggttatgcggcattccaccgtgttgatccatatgcgatgtgcttagcacagatcggtacgcaaatgaacatcactacaggtgttccactagaaggaaagaaccaaccagttaaggtaggtgaagagggaactcttaacactcacttctttattgagggacctattgcaggtaacatcaattatcgagtgcgaggagttgagcattggtacgagtaccatgatgactctgttcacaacattgaccttactgcggcaggagctccaactaaggcatactctacgccaaaaggcattcacgtgttaaattatgtagcttcgtcatcgaacatccagatggcagcaagagagtctttaactagactgactctaagcaacttctaattaacaaataatagacttcggtcgggtagcgttcgcgccccc

SEQ ID NO: 696 - DNA, 1745 bp, Unknown
  derived from dsRNAs of unknown virus
gaatagattgtcagctactttgagagagacagaagtacgatgagcgatggctatgattcggtcgccaacagaatcagcgatctgaatggcaggatccggctcgtgttagagatggctgggcgtaagagcatggaagacatctcgcccagcctcgacgagctaatgaagcagcgaaatatgagcgaggaggataagaaagagtatctggaggaacaagaggttgtgaaaaagcagatcgaagacagtaagaatcgcctgaaggaccttgaaagacaggtaactaaagagcggttattcattggctccaaaggatatatattggaggataagccattcgaaaagcaggcggctcgtgcatacctcaatcttaagcaggaggtgaatgacataaaaggtgagcaaaatatggttgatgatatggtggattttccaacaccgttggagacgctacgtcgcgcacttaatgaagcgaataaagtatatgacgacattaaaaccaaggttaagggcatcgaggagaagagggctgacttgaagtcgaaaatagaagatggtacgcgggaatttgagagactcattatggttagacagataggaatggagctcactgctgtcgaggctactgagttgacgaatgccatcgaggaagtaaggcagacgatggcagcgtatatggaaggctatgaccaccttgctaaccagctaaaaacgcagaaggataaattgcggaataaaagctatgagctaaaggaaacaaaagacaagatcataaagcttgagacatcctcggggctctcctggcgtgatgattgggtgcgtaactgggatgatgccttcttgtttgaaggagtgcaaccagagttgcttatgctattaaacctatgtcatcattactataaaaaggaggaagacaaacgtcaggtaaaagcgcttgaacgggatgaaatggaagatttcatggcgaaaatcagcacgctgcgtgtccatacactgaagacgatcggagatgatgtggtgatgaacctgaaatcaattcaatctcgcgagcgccatgcggtaaatgcactcagtatcggactgcgtctgacagccgaagaacttaagcaggggaaggtcatcgggcctacagctactgctgagtacatcggagagttatatcaacgtaatcgttgggacgaaacgaagaaaggtgcatatgcaaagaccaatctgtgggacggaaagtcacagtaccatatggacgcagatgcgtacctaaacgccgtaaacggtgcacttagtaagaatctgcacatgatttttctagatggatcagacccacgtgacgtacgctctaggagtaacgtcttaggaagtgatccagctggaaggctgaacctaatcgatcaggatgtagacatcctcatcctattgaacaaaatctctcgaagcggtctggatccacgtaggtggttgagagcatgcgaagtaaccattggcgggatggtgaaccgcatactccttacatgggaacagaatgaccggcgcgctctcactgcggatgaattacgtggggcctttgacccacgttttcaaaccgtcatggcttccatcgagtatgtagagtctgaccatagtagaatgcgtccgaaccgtccacgtgatggaaagtcgggtgcatacacttcggaaggtgatacagacagcgatgatgagccagatgatggccacaaagagtagtgtgtaagctgacttccgaatacatc

SEQ ID NO: 697 - DNA, 1722 bp, Unknown
  derived from dsRNAs of unknown virus
gtaattaccagtttttacaaactacgtaattcaaataaaatttgaaataacatctaatatatggaaactattattctttcgccagagtcactagatgaacagctgacaccgttagctcaaacccaggctgccgcaggattccaaatgttgcgtgaaggcaaggaaccaactgccagaactcctctttataaaggtaagtctgaagaggacgttgtagctacatggctcgatgtcttagcccgatatgaggaggatgaagttttgagacctcttatcgaatacgacaaatcgagaaagtctaaagtaggacctcaaggtgggtaccctcctttttctgaacgtaaaccggacttcgacgcatattacaccagaccagaacaagacgaattcgagattgattatgagatctgtgaagaaatataccgcgaggtgtttggtggggcaaaagacaagcgaccattgtcgccgcagaatgttatcgaccgagatcagtacgatgacaagctccagaccaattcaggtgcgcctgattatggcaaacggaaagatccaatgatcttagccaaggcacttgctgatgcagtaagtggaaaatggaaaacctacgtgatgctgttaggaagcagatcgcaacgaggaaaagctcgctttatcttcatggccccattcagtctgaacattattgaaaagacatacttgtaccccttaatggaaattattcgttctttagacaacgatttcttttcagcttgggaaggatttagcgaagtagaactaggtttctatcgccaaagattcttcgagggagatatcttcgttcagcaagactacaccgctatggataagtctctcaacaatacaactattaaaatatttcttgccatagtcttacctgtttttcaaaaacaataccaagaaagttttaaagagttagtatatcatattttcgacataccaattatgactgctttaggtaaagtggtagtcggacgacatggaatgccaagtggttctggattcactaatttcttcgagtcaattatttcctactatgtgtggaaacttaacgttaaacaaagcttaagaattgcagaagctcaaggattaggggacgatttagcattctcaatacaagcaccaccaaatttacgatctgataaagatatgtatgaaatttgggcagagacgatggtcgatcacattatccctgatgtaatatccgaaactagcgcctctataggtttagaagttcaacctgaaaaacaactagtggacagatacacgacaatttaccttcaaagattctttgacattcgtataccaaacacggatggcatggttctaggtatgtaccccagtattttggcattgaataccgcgatgaacccggagaggtttcacgacccccgaaaatggagtagtaagatggagatacttcgatggatcatgattctagaaaactgtaaaaacctaccgtatttcgaggatttagtccaattctttatagaaggagacaagttcaaaatgggacttgaaattccagatttctttgtaacgttaccgtcaattcacgaagattcaaaactaattaaaggtttcttacctacttataaccaagagggaattgatcgaggaatcaatgactttgcgactgttaagtatttaaagaaattggccagccaagcctaagtttgcacctagatgtctccatctaggtgtttt

SEQ ID NO: 698 - DNA, 1732 bp, Unknown
  derived from dsRNAs of unknown virus
ggaaactttagtgcagaagatcgaacggacgcgatacgcactttagggactgatatcgaaaagaaaatgaacagaaacattatcgattcgacaaacaacggagaggccaattttgatgcgaatattggtctagggagtgaggcacatccgtggactgactcaccaggcagagacagtgacgtgacagtgtgtatgcctggaggtaggatcgcagcacgtgcattgagccgtcaatcctcatcagacagcatacctctggaagaaggcatgctggggaatgggactttcggtttcatgtggaattcgaactccattatgagatcggaaccaatgatggcacggtctctgggctcgctgaatggagtcggaggtcgttttcaggagtcttctgactacggcctaaacgatttgccggctacatactcgatgtcacttgagttgtattgcatagcgaacgtatcatcagtggttggtgaatatctcactaaggtcatgcgggatgtacataagaacattaccccagttcaaagcatggacgagagcttacgcgaattcagaggattcgttaaccggctcacggaaaatgctgtagagttcaattccagtattgccaagtttacacatgccggtaatactatgggtgtgtgcaaacgagcgtacgcactggatgctggctttggtagtgtttccaatgatgaacgcgctccaggttggggtaaacgttcggcaaccacgttctggttaccctgcggtgggaatcttcgacgcttggttacaatgatgcccagctcgcaaagtccggacgacgctgatgacaggatcctatggattacggtacacagtgtgttgaacgagcttgagtgccttatcattagactcgcggaacatatgtccaaacacgaaggaaccaaacgtcgtggagcgtacgccatgaagtggggtggtactacgaatggtcaagagtggatatgtggtgtcatgtatcgacgatttgctgatgtcgcggcattacgatcgttcgtactggcattccgtggatactgggaaagtgtgcaagatacggctatatcgttggattctggtcgaccatattttggtggctcgatcagtgaactcgaggagccatggatagtgaaatggacatcaaatgccactcatgcgttgcagatgatacactcggatcgtgtggtggatccgtctggacatcttcaatcggtgacagattaccacgaatctgcgatagtgttcgtacgttccatcaatatgatgcgtgctggtgagaccagtgtcactttcattggaagggaaggtgtcccaatcgactcacatacatttcctcctctctcatattgggatgcattacacgtacttgcctggtttacgagggtgaacagaacggttgaatgtacaacacatggtgatgaaggagaggacgagcctcccgctctcgagaactatgacagtgatagtagtcatggttcggtttctgattaagatgtaggtaatgaaagatgatgaaaagggaaaaaataaataatgatactgacaatactaaaatattatactgtgtgcaatttgcagaaagtttgtttttcggaacccttattgcgggtaacgtaacgttgaatcatgaagtggagctatgtctctcgccacgtgtaatccatggtgtctttcttcatgtgaatacgtgtaccatactaactaaaggggtcaagctagacttgatacc

SEQ ID NO: 699 - DNA, 1651 bp, Unknown
  derived from dsRNAs of unknown virus
ttataaacacttagattttaatctataaaattattaaatttattacgaaaatttatgtcagaaattttaacattgacgcaagctcaaattgacaaactattgaacaaaatgggccagtcaaatgcttccggattgtttgaaagacttcgcctaggacaacctccaacaccgagaaccccattatacaaagacttatcagaagatgagatatttgataaatggaccgggatgctagccgatttcgtagatcgtaatcctatttgtgctcgcttagcagaatatgatataagccgcatgtcaaaagtaggtccccaaggaggacttcaacccttctcgaagcgtgagaacgacttcttcgattattataaactgccgaagaacgaaaactttgagatagacttaatcatcattgaagaaatgaaagtcatcatgtttggtgatttgaaagatcggcgtcccatagcgcttgagactgttgtggaacaggatagaaaagacggcaaactgatcacaagcagtggagccccatcatgcggcagacgttccgatccagctattattgaagaggcattaaatatagctaaaagtgaaaaggtatggctattagccatgatcttaggatcaagatctcaacgtggtaaagaacgctttatctttatcgctccttttgctttgaatattcttgaaaaatcatttttatatccactaatggatgctatcagatccagaaatataaatttcttctctgcttgggagggcatagatcgagtgagcacaggtttcatggatcaaaacttcttcgagacgaatacgattttatgtcagcaagattatacctctatggataagtatattaataagacatgtattgatatcgtgtacttatctacaaaagaattcttccaaaagaagtatcatacggaataccgtaagttactagaccatttactgactatcggcgttatgatcaacgttgacaaattagtcaccggagtacatggaatgccttctggaagtggtttcacaaactttgtggaatccgtggtctctctatatgtatcactacaatacccggaaactgaatcgcaaggtttaggagacgacttagcactctcatttccagtagggatcgaccatgaagatatcaaaaagttaatcacatctgcttcgaattctgtaggcttaattgtcaatccggacaaacagcgaatagatgatgacacgattgttttccttcaacgcttctatgataaggagttaattacagacgggatagttgaaggaaattaccccagtattttggcgctgaatactgcgattaaccccgagcgataccacgatccgcggaaatggagtggaaagatggaaatactccgatggattatgatcttagagaattgcaagaatttgccttactttgaggaattagtccaattctttataaatggtgataagtttaaactcggcatctcattaccagactttttcgttatgttacccaaactttatgacgaaagcaagctaataaagggtttcacaccaacttataatcaagaaaatgctaaccgaggcattaatgattttgctacagttaagttgttgaaagaaatcgccacgtcaggctaagcaagacccgattccatcgggtcct

SEQ ID NO: 700 - DNA, 1671 bp, Unknown
  derived from dsRNAs of unknown virus
gtttaaaaacaaaccccgtgaaaaggaaaattaaaggaattatatgaaatatataaaactaatgcaagaaggaattaataaattcctaacacctgctgcgcaggatagagcttccactagctttgctcgattagtgtcaggttgtcttccgacaccaagaacacctctatataaaggcctaacagaagagcaaatcttcgcacgttggaatagagtgttagatgctttgaaagcttccgatgctactctccaagatctgattgactatgatcagtccaagatgaagaaggttggtccccaaggtggattacgccccttcgcagagcgtgaagatgatttccaagcgtattatactacgcctaaggaaattgatgagtcagcaattaattctgaggccattaacgaagctaagatcatagcattcggagggaataaaaacaaaagacctcgatcatatgaaaaagtacttactcaggaccggtatgataataagcttatcactaactctgggtgtactgatttcagcaaacgtaatgatcccaatgtcattgcagaagcgttatattatgctacatcaggaaaatggagatcattacctatgatcttattctcgcgatctcaaagactcgcagaacgtttcgttttcggagcgccgttttcgcttaatctagttgagaaaagtttcatctaccctatgatggaaactatacgtagtataggtcatccattcttcagcgcttgggaaggttttagtcaagtagaaataggtctacgagattctaactttttcagtgaagggcacacttatattcaacaagactttgttaaaatggataagcatgtcaatatgttgcaaatgaaaatagtagaattaataaccctagatttttggcaaccactatggcaatctggttacgcagatattctcagtcacgtcctatcgattgaggttctaattaatttagatactctggtcactggcactcatggtatgccatccggatctggactgacaaacttcgccgagtcattaataaacttatatattatgttatcttactcttactatggtattgaagtcgtagctattcagggtcttggcgacgatggcatattagcaattattagaaacggcaaaacagatgaagaaattttggaagttatgcaaaaggtagcagcctctgttggccaagtaattaaccccgaaaaacaaggcatatctgagcacacgacaatttaccttcaacgcttcttcgacgacagacttcccagagtcgacggaaaagtattaggtatgtaccccagtatactatcattaaatactgcgattaaccccgaacgctatcacgacgcgtcaaaatggagtaaagagatggagacactccgatggattatgattttagaaaataacaaaaacctaccttatttcgaagagctaattcaattctttataaagggagataaataccgcttaggtttagatctaccagattttttcataacgttaccttcattatatgaaaaatcacaggatattaaaggcttcgtacctacttacaaccaagaaagtttagatagagggattctagattttgaaactgttaagtatttacaggagttggcacgataggccaaaattccggttccagtcttcatcacagattggaattt

SEQ ID NO: 701 - DNA, 1633 bp, Unknown
  derived from dsRNAs of unknown virus
gaattaactacctcgagtgatcttacgttagggcaaaccgatacccttaaccaattgagccaagagccaatttttcaatatgagcaaagagacttatcagcttaccaaacgcaggagcatccatggcagcttcgtagtatatcagtcgatgaaaaagatggcaaagacaaccatcgacccggttggtcacctcatgggcaaacgtaatactggggttttcacagtgagccctaatgattacggtacactgagtacgcaccaagacttggttaccaatcgatatgtagaagacgattccactgaagtcgccgatggtgctcataaggccatcgcctatatcgaatccgtttcacagctaccggagatggatgctgtaaacgatgatgtaaagaaagcgaatccgatgggagcgtacactaataaaacgcactggaatgaagagactgtacgatcgcgcttcgacaatattcagtggttcgataatgcatgggagggatactcctggggtgatgaagatgttaccccaccatgcttctggaccaagaactacacggatctcgacgcgaatgatgatcatacacttgattggaaagactatgaggaaacgcaccaagatcgtgggtggcgagtgggattcgacatcttcagtacatacgacatggtactgagcgcactgatggactttctgaacatgcacattcatgaagtgcacgtgtggatacaaggttcactgcaagacatgagctccacagaattgatcgcaagacttaagaatgatgcgagtgaggagtttgagaattatatgaatggacggaagaatgcacaggccctctgggaagctgacttatcaacatcaacagatgtttaccactactatgcttcgcgcccaccgcaacgaatcccaacggtaccgtggcgtgtgtgtaacatgggaatgcgacagtttccagatcagaagcctcaagtgtatcccgccacaacctggatgggggaggtggcagcgaagatggcggcagcgaagatgccagagacggtaatgcatactatactagaggataaagtgatatacaccaactactccggatttgtaaaaatgatacccatgtggaagcacgacaagctggatttcgcttggaaggaggtgcggccaaatgagtatatgatcgtcaagaatgggtccgcaccaggaccaaacggatatttatataaggtggcaaaccccgacttctttatggggatgggctcagtcgcaacatcccagcatgccgcgtttggagtgggcagaagtgagagggagctttatgatcaaatggtacggaaagtagagacaggaaaggggacatcaggacatatgattgcaagcgccctgtgtcatcgctcccatctactgtggtatcttgaagaagtctacacaaacttaaaattgaaaaagagtatctatctgatgccgttcaatgagccggaaggcgcagagtatcatacggttaaagagtatcaacatgccctaacagacatgaaggagatcatcagaaggaaggagtacccgaagtatgcagtcgtgcatctgatctactgctacaacctggtgaaacacttctcgtaagatatggggcactcgtggttgtggaacatc

SEQ ID NO: 702 - DNA, 1555 bp, Unknown
  derived from dsRNAs of unknown virus
gggaaaagctcccaggaagaagttatatggaaaagaaacatgaagcaaacttaggagacatcattaaccttgaaagcattgacgtggccagccaaccagatagaaggcagagcacgatcaaagatcgcaaagtattattgactgaccaaagtcttgaccgaagagttgaaattgttctagcggacggtaaaacgatgaaagtagcaacctcaccacgtgaaatagagtggcaagcatgcgcaacaatgttgaaggaccagtgtatagtagtcagcccatggagaggcgctgaacaaacaaggaactacacagtcaacaacaagcgtatcgagatgaacctaccctacccagttatgggagtaagggcagcgagcatcagagagatggcttacatagtcgagaacccgttattgacgaccagattaccgtcagacgttagtggaccacgcagaagcatggtaccaagagatcgtgaagatcgcaaattcgtcctcaaaccatggaaaacctaccccgtttgtacggatggtttcgtgaagtggtttgctagtcgtgtacctaccgtttggcccttagaaggtaaccagcagactcgaccaccacacagttggatggtgatcgcagagtcgatgggaccgtggggtcgcgcgatcggtgacgattggattaaagcgaacagcaaaaacaacaacaaggaggaaaagaaatgagcagtgaaagagcgaaatatgcaaacaagatagaggaaatggcttttgtgtcagtaccagggaaaccaggtatagcatttcaaggcactcgagacgagtgtatggaatggtcggtacaatacagcaagttacacggtagtgtagcgaaagtccactatctcagagcagagccggaaaagaaaaaggaataaacaaggaagtgaaatgatgaaaccaaaagtaatgttgagagaactacgcagacaagagcgacacgtactaaaatacgttcgtaagttaggtagcgaagaagagcgcatgaagagatccctaggtgatgcacctctggaactacagacagcactttctgcagccaaagcaaacttgacccaggtccgaaaggatatcaaggaatggagagcaaaagcagcggacgcaccgaagccgattgaagagagtagcctaccacatcacgaagaagagtgatttagatggtttggcaattcgttttgatgcaggttgatgacttagttgcagcgaaaggacgagcagtgcacgttgaggaggctttcctcaaaacaacggcacaacgttcatacacgttgaaggcttttaaggtaatcgtaaagcgatacgagaaagagtttaattactcatactcggaaccttacattagtcacaacgatttgttgtactgctaggtagtgtctcgaaatagcttgagaagcgtctatgaatgtagagacgaccgggaaatggtgaacctagaaattaagaaccagggtaaggcccttaaaaacataaagaacaaaatccgtgtggagtggtacggaaagtctggtaagacttgctaattattagcaccc

SEQ ID NO: 703 - DNA, 1596 bp, Unknown
  derived from dsRNAs of unknown virus
acaatacatactaacaggaatctatcgcccaatacaaactacgggcgaaacacctacaaccaaatggatactatgacctacgctggacttcgttatacaacgacccactgtggtagttatacatccagacatccagactccctcaccgcaatcaaaagccatacgatgacgccgatcaaccgattggaagaacaaactcttatggatccctggatgcatgaagcgttctccgcttctccccgagggtacgacttctccaccatgcatgggtggtcacgaagttactacacacatcaaggacacatggactctctcctccgcatcaaaggaatggctcgaccacatcgaccaaacgacttctcaatgtccgccgttgacgactacactcggaaatacttcttaagttttccgaaggttatgtcaatggatttcaaaactgacttagaccaagtcccttttgaaccttcctcttctgccggaatgacacttcccggtaagaaaggcgacgagggaaacctcactcgtgcaatcaatcaggcttacgctaccatcaaagactgtatgcgtggaaatctccagcatcagatagatgagtcagtccctgacatcgcttataccagaacgcagcttacccaaatttctaaaggagttaaagttcgcaacgttttcggacaagcattcaagtacattctactagaaggccttgcagcttcaccgctcatggatttcttctgtgataatgatactttcttcttcattggtaaagatccgcggatccacttaccatacttatttgaagaagctaaggctatcgccccaaatctagtcaccattgactggtcagcgtttgacactaccgtcgaaccatgggagatcgaaacagccttcgacctattagagctcatgctcgaatttccaaacgacgaatctcgtgcggcatttgagttcacgaagatcttctttatcaaccgaaagatcgcagcgcctgacggcactacgtatttcaaagagaaagcagttccttctggaagctactatactatcctcatcgattcgatcatcaactggagacgtatcctatatatgcatcatcgctattacggaactttcccgactcgaatctggacacaaggagatgacggccttatcgctacccaagataacgtcacccccgaaggattaggcctcggcttgccaccacgacacttctggactttcaacggttcaaaatgtgtttccgcaagttcagcttcactcacaccgtttctacaacgtagactcaagtggggtgatcaagctcgagacgtaaccagagtcgaaagactcgcaatctaccccgaatacgaggttgatgatccacagatctcagccttcagagcacgtgctctctgggaagactgcaactatgaaagccatattctcgcattcgctacagcgtttcttgaacataaatatggaattacagactctccacctcgtagattcaaaccctactggcagatcctgtttcgcaagtaatcagcaacaacgttacatgttaataatagataattaaaggcaaatttagcctatatataataaataatttagttactc

SEQ ID NO: 704 - DNA, 1587 bp, Unknown
  derived from dsRNAs of unknown virus
gaattgaaatcccttcctacgataggaaataaggttaaataatcaagagagagatggactatgatagtcgtatacgaccagtaaatgtaagggcgcgtagtagacgagcaggctttagagcagcaggagcgggctacgttagtcaatctttaatgcgtttcaaagtacacactgataatgacggtgtaggttatatgcgtcttgggttgaatgacgaaagcgattcgtcgttagtagatagcttcgtatatcgtaataaaattgatgatttgtctacaaagatgaacatatctagcgatttggctacgatcgaggttgtcgatttatttatggaaatgcgtgatgaaatacaaccaggtcaagtgttcgaaaagtcggagatggataagttcaggggacgtgttgatctacaatcgatgatctgtaacaagattggctataaccactcttcagagtggtatggcgcgaccctacgtaacgtgttccataagcactcaccattaatccagtacactgaaccgtgcctattcgatttcattggtaacgaaatcgagatatcggaaacaaatagattgctgcattatatgtcaacgccagaagatgtgaataatgtaaggcattcagatagagtgactgtatactcactgggtgttaagataacgttcttctgcatgacaacatcttcacgtacaaggacggatcttgccataaatctaaacacaagttcaagccacgatttatctcaagtagtagaccatctacgtatggccgataaagtaacgattggtcaaggtagatcggaaaaagttgtgccatttgtcatcgaaaatatggatctggatgagggcacagtgataatgcatttatttaagagcgaacaaggcgttggtttagtggattggatggaatattgcgtggaccaacttgatggtcttctgaaatcgctattaaatacactgacgacggagagagatactgcgtattactcacgtggacttggtggaagtttcccagctaatttctttagatcattacgtggtacaatcgcggcatacgtgaacgaaccatgggaaacgatcgcccgattctctaatagtgtagacattcggagcattctaatcgcatatacaaccagtccaaatataagttcgctgccaatgagagaagcattatcgttcggtaataatgtgaggaatgtcgaaatgtttgtcaagcacctactgcgcttatgcatgaagtttgatacgttttacgatgttatcaattttaacacaaccgacagaaatgtatatgataggcagcgacaattacgtgtgctagatgtgctagagatgattagtaaaggttcatataataaatatgttgacttacaagatgactcgatctttcaacttatgcgtaaaattaaacgcaaagaagaagacgcaacattagaaacggagcaatatataactgagtcagtaacgaaaatatccacttttctcaacgatgaatgagaccttatatccacgactggtgaaaagtactgacaatacccctaaacccggatctatagtagggccggccgcggcaaaggatggtaacatc

SEQ ID NO: 705 - DNA, 1559 bp, Unknown
  derived from dsRNAs of unknown virus
gaatatcttactgtcttttacaagcatgggcatagtcaaatctgatagtgagagcaagaagagcaaagcaaatcaattagataaacgactcgtaattaccagactccgaacaatcatgggagcattcattgtcggagattttgacaccgacatggatccaaacgctcacctgatgcgtaaggcgcattctagaataagactgttaagcaataacgatcttacgaagatgtgtgaggagtacggatattcactggagaaaggtctggcttacattgaagccgtaacccagatgccggagcatatgccgggttccttggcatatacttcacgagcacacccacttccaacgcatggaccaacagaagtggacatactgaacattcaatggttcgacaacgcatggacaaataacagttgggacaagttgagccggatgcatgatggtggaccgcctagtttctggaccaagaatttccatgacaaagacgatcaatttaaacaatcgtttgagacatacaatgcgctgtatccaggacgcggggtgcgtattggatatgataagtatcctacttatgacatcgtgctgtccgaactagtgagattcctgttgaccttcccgttagaggagaagcacgtgtggattcagggcgagctggatggaatgtcgactacggagacgttgagacgtctgcgcaatgacattgttatagcgttttcccgtccacgtgcacagaactccggagtggatccgaacgtcacgtcatactggcaaagttcagtggttgcatcgtacgatctgtattactactacggtggtcgtacaatccaacgtataccagttgttccgtggcgtgcgtcaaattttggcatgcgtgtatttgctggcgcattagcgccacaaatattccctcccacaaccttgatgcatgatctaaacattgatgcgcgcattgaagagtcaaatggaagcgccagtggtccgatgatctacgctaattattcaggacacgttgagctggttcccatccatgaggaggattacctggattttgcatggcacaagattggtgacaataggttcattatgcaagatccaagatcatggataccttccagaaatgatggtgcacacttatacaaaatagcggatacatcattctttaacggacttggatccgtgtgtacatgcgcgcacgccgtgtacggaataggccgaagtgagccagagttgtgggagcagctgcaacgtaagttgagtacaggccatgacacttctggacacatgttggcagcacctgtgatgcacacatcacacatgctgtggtatctacacgaagtctatacaaatattatgagagaggcgagtatctataacctgtcgtttaaggaaccgacagatgggttatatcacactatgcaagagtacgaacatgccatacaagacatgcacaagcttgacagaaacagaatgtatccattttatgctagacgaaatatagcattctgtactgaattcattcgagctttagtgtaaggggaaagacaataagtgatacatc

SEQ ID NO: 706 - DNA, 1546 bp, Unknown
  derived from dsRNAs of unknown virus
tttgcaaatcataatgacaagtcgtagttcatcagcaatcgtcgtgccaaggcatgttataacgacaaacgttagcgagaactctacggcgctaccgacggcaggcgctgttcatacagcagcgaacaacgccgttaccgcgtcaagagtattatcagcaataaatactgtaacatccattgatgtcggcacaacaacgttaggaagcaacacatcattcggatcactcccaacttgcggtagtgtgtcgtcaccaacagcaccgacagccatcaatgagctctcaaataaaggatatgtcgacacgaaaacgtcgttaacatccgatgaaacaattgctggagtaaagactttttcaagcgtgcctgtatgttccgctaatccaacaaatgtcaacgaactatcacgtaaagaatatgtagacactaacgtgtcgctaaaagtctcattaacaacggatgaggacataagcggcgttaagacctttacaagtgtgccaaaaagtaatgcggcgccaacagcaacgaatgatctaacaaggaaagattacgtggacacaaaagcgtcactaacagaagatgaaacaatcgcgggggacaagtcatttaccggcgttgctactataacgaaagcacagacaaccactaacaccgtagataaagaattagtaaccaaagaatatgtaacagttgccatagccgccaccccatccagcagtggggttccaggtgtggcgtcatgcaccatgtatcatcctacaagtgaaaacaccagaactgagtcttccgaatggatcattgaaaatcatggaacagtgttcgcggaaaaacatgctattagaggatatcatgcgtcaaatatcggcagccgaagaactggatggtggagctttatactggaacgaggtgtataccaaattacagtagatggggtaggttttgccactggatcaggcgttaaccactttggcatgggttttgatgtagatggtgatagtttagcaggtagtaaaactgatccaagtaacaacaccgcttcggacgatcttcacccatttgaagctgattatacaagaattcacagaagtgggaattggaatgatactgaacgtcattactgtttcacaaaggtgatacgccataaaaccatattcttcttcatgaatggctctgaagctagtaacatttcatacggatggaagcacaggactggaatacctggtgcctccaacaacacgggtgcgaaagccgtggccaaaggagtaacactcactttcgtacggctagcagtgcctgaccaggtgggtaccgatcaaactataaaaactgcatcgaactcaagtgggattggtgtattatcggggacgaccggtagctttacagcattgaaaccctttaacgagacaggaacctacagtggtaccggcccatactttcttgattacacgtaatgtaacgtaaagagtatgacatgtacacacgacgaacatgatgactacaacacgaggagccaactcggttattacgatagaatgaacgaaaacatc

SEQ ID NO: 707 - DNA, 1372 bp, Unknown
  derived from dsRNAs of unknown virus
acaatatcttaaggggacttccttaggtgagtaggagctgaatagaatgatgatagaagcactgaaattagtagcgcgtatcaactggtttttccagatgatactagaaagaatgagagaaataggtccttggatggacggtggaaactacgccgaagtaggtgacaccgcctgttccgagtacgaacgcggattgttacacaacaacttcatgggatacctacgcaagtcgatgacttgtcagcttagagacattatggatctagactacgagatcattaacatggcactggtaccttgggctgtggattttacacaacccagagaatggagattgcgttttagatcttacaacttcgttcatgatgaccgccatgtgtggtacgttcatgaagtcgttggctcgaatctttctgatttgaagcaactaatgcaacttcttattagcaacatcaaacctgtgcagtggcgctttgacggatgcggtgaacgcactcgtcatttaggcatttattgcctgcgcaccgagcacatggatgatgtctccccggtcgatttagtgagttcagtctgtcaaaagctgaacgtcgctgtaatcaacagccactattccactgtgaataggtttggtatgccccatatgcccatctctgatgtggcaaactttgggtgcacccatccagacagcagctggccggagttttggagagcagttagtgtaatcgactatactcgtacgaaacagcactggaaaagatacactccttcaggaggtgctaatcttggacaagaagaatgagaaccgagttcttattctgatcgttgggatcaagctttgcgttaagcttagctatcttaatggtagtttgaaggggacggaaacttattatgagattccgcacgacgaatattggatcaagaattatggtgttctgcccaaggtcatcgaagcttacggagacgtggctttcgttgcgcctaacggctatttccttttctggcaacgtgaggatttcaacgctaccgaaatggtagggaagaatcctgatcacatgacgcctgaagtttatagttggcaacatctagatgccttagaggacctggaggccataggtgatatttaaagtggtttagcttcgtgtagtgcacgttaaacactctataaattatgtgatatagttcggtggtttccccctccattatccaccaatcatactctgagcctgaggctcctgtactgagtctgaacaactcacgcccgcagcgcaaatagtacagataagatcacagattgtccttcccacattgttgcaaggatgacacaaccagtttctgtgatcggccatcattaccctgtgggaggggtatagct

SEQ ID NO: 708 - DNA, 1536 bp, Unknown
  derived from dsRNAs of unknown virus
ggatttttgaaaaatgagcgtctttaacatgctacagaatgctaacaacactcctactcagaattctacagattctatgaatgatactgagccattgatggaacgtacaatgtccagcaatgatgacgtcgattcgctatttagtgaatgcgacgcattgttggcagattacgagtctagtgcatctacaccagtagtgtcaccaacagacgacacaccctcggtgttcataccaaagcctaagccaaggttggataccatcaacgaacaacaacaagtaaaaccacgattcagtaaaccagttaatacaacatctacaaattggaaaagtcctaaaaacggaaagacaacacgacgagacaattacaaacaagaaaggacagatgcacgatattctcgtaatacaggtggttcaggaaagaaatgcgtcatccgttcacgccgagtatcgactaaagatgatggaatgggaaggactgtgtttgatgatggcctaaagcctaaaacggattcagcgaacgtgacatccgttcccggaatgatcaaacaattgcgaggccattttaataacagtagtgggtttaccattactgcaaatcaaccactaatcacattgaacgaagtgtcatattcagtccctaaatgtacattcggacacaatgattttatgtggttctatgattcaattattgactgcattgagaaaggaacactggatatcaatttcgcaccaaccagcaagttgcacactactgataggagcgatttgccttcggttgatcagctaaggaagacacgagattttgtaagtggtcattgtattcttacttgtccattgaggtcaagggatactgatctcgaatcaggtcgatcatcgggacgtgagctcaagtacaatgcgtttactcgtttcggtagttatgtcactccaatggatgcattcgatgcaatgatcgataaagtcaatttttctgacctatctaacgactttactgactttattaatgccacaaatggtgattatttgttattcatcgtactgataaataaaatgtgtgatgaactatcactttctcagacctcgcaactagttccagtactgcctggtgcaatgaccacagatttgtatcattctctggatgactgcaacactattgatacatcaccaggatcctatattcacaacgttttgactaacatcactgatacaacagtgcgaacgaaattagaaaaaagaattgaatttgtgacttacgtacagaacatttgtagtactggtctacgtacagctattgctcgcggaccgattacactaacattgaagacactacgtgatgatgagatttgcattaatgatgaactcaatcgcgtacgtgcacggatgtttacaacaatggcaatttatgcagaaacaatcgagacagtacttaaataaaacaaccaacgttaccattcttagccggaccgccagtccaaagatttgatccgccgaccaccacgggtcatagggtctttattcagttcaaataaaatacc

SEQ ID NO: 709 - DNA, 1514 bp, Unknown
  derived from dsRNAs of unknown virus
gaataatctggaacgacgacaattagagaagttataatgagtaattttgataacgagttttttgaactacaaaacctagcattaagagagatcgaggcagcgcagggcccaaacattgggggactggggaatgacgagttcaattttcccacagttgctgagcaatttgaggcaattatgatgggagataagacaatctccctcaacgtgcgaaatgctatcctgaagaacgttgtggaatgtatgacgaagaatagtggcgagtacgataagtggaataatgagaagcagcagttaattgataatgaatccatactgaaagaatcaggtgaagcagataaagtcgcgctcggtgaaaaggtataccgagatgtggtagagagaacagcctccaggtatactgaagaagaagctgttcaattcatggatatatttgataccgtgcattcggccaatgctgatgcctcatccccgaagtgggacgaagtgccgttaccggacggctggggcaggcgcgtcgaccctgaaacgaagatgacgtactatgttgaccacgtcaacgagaaaacgcagtggaaacacccgctttacaaaaagcagcaccttgcaaacactatggaggaatttgagaaagtattgagagccaaacctcctcaccaccggctcggcatggaacacggacctgcaccacagatggtcctcttgattttccataattacttgttggaggatcataggatcaacgagcagtacatcatggagcgtgatcgtaatgcggctgcccttgcgctgcatttaagtatgaagccagtggacagatcgatcttacgagcggaactgattgcttctgaaatagttggcttggccgatggcgaagtggctgaattgaccgagaaggattgctttcacatcataaagtatatggctacgcgttttcacctgaaagatgatgcagggcctgttctggcattgacacgtctcgacggaaacctatcggataccgcagagttcctcgcagtacgatatggtgcagcgcaggcggaagtggacatcggaaacttgagaaccgcgatggaattctcagaggccgcctttagagggctatcaaaaacatcagagcgtgaatcgatcggggataaatttgctgaaaacaaactgtttaaagaaatatctcattgtaatgaaataattaaagctggttatcacccaatgcgttggcgtgaagcattcgggaaatcaacaagcgggatgatggaaaagatgctcaacgagtgggtgaccagtggctataagagcttgactctggctcagattcataagctattcctcccgatgatcgggagtagtagcgcactttctattttgattgaagacgataagcaagatccgagagaagataagctactctcggcttttaaagatctgattgaatcgcgtaagaataaggaaaaagaaatagttgcacttggtgatgactaattaacccttatcgcctcgaaccggacgtaaacatc

SEQ ID NO: 710 - DNA, 1483 bp, Unknown
  derived from dsRNAs of unknown virus
gaatattttgagagacacatacacattttaaattgaaaacatgaaatttaatattaccgatgaggtggaggattatgatgaacaaattagagacatactcgaagacgctgaagatttaattgatgataatcctgaggatacttctcgcgatcgtttggcgaacgcaggtcttgaagagatctacaagggcgtacagaacattaaagactgtattaacaacccgcttgattcgcgtcttgaatatgttggtatcgatgctttgcgatatgtagttagttcataccacgcacgtgattcggggctcgaaaaatcattgcgcgataaatacgatgaacgtgttctcgtaatgcaacgtcaggaggcgctaatgaataagatatcggaagaacaaacagaactgatttcaacacgtgcgcaattacatgggcttgaaaaggaactacagcgtatatctaatgatgactatgatatcacgaaaaggctcaagctgagatctctacaggaagaaatctctacgtatgaatcgatggagaggtatagtaaagagcaggtggctaaggacaatgccatggtaccaagggttcaagctgattacgatgccgtgcttcgtgaagttgatggtctagtaagtatgacgtcacaagtattgtatggtccagaagttatgcttctatgtgcaccaaactacataattaataccgatgtggacttgccatacataactagcaggatcagtgatgaaattgagagcggaatcgtaccaacattaaaagagcatctaaacaagataaaactcttcaaagatgaaggcaagggatcggagtttgcattgttttcgggatcatcaaatttaccacaacctttaaaggctcgtggcgaagaacaaaatttattgtccggaccgctactctctagttataatttctttaagaattcagagattggaaaggtgattcataacatacacgtaaacgcgcttttcatgcaggtgttcagaggacaggaatttgatacagctcgacaaaatgaaatcatgatgaaggatccaattaaaaacctagacacatcattaatgaacgaaatgtattttctaaacttaacgtgtatgtctggctacgatcccattacctgggcacggtgttttggagtaccaattagtggaattggaaaacaaatactgaagggatggaggagtagcggtaaaagaccactaaatgctgacggcctaaggaaaatattccttgaaggtgaggtcagtaacgaacataatatgctacttgatgtcaccactctcgagtacaacgaatcaatcaacgataagatgaaagagaagcgtgacgcgcaaattgcagcattgaacgatactaaactgataactgagcaagttaaagctaaaattagatttgataagcttataagaaagggggcggattagttatgatttgatttacgtctaattacttttcttctcaaatgaaacatc

SEQ ID NO: 711 - DNA, 1437 bp, Unknown
  derived from dsRNAs of unknown virus
gaataattacaacgtgtttagattttaaacattaggtgatacgcacaaagctaatatttataattacgagtctagtaagtatagtgtaaattacgaatagacttatattagatgccacagtccaaaaagtcagttactaaaagtaagccaaggcaagaaactgaaagaatcgaaaatcagcaacctatgggtggtggccaaacaaaggagccacttaatagacaaggtgaagttacgatggaggaaaaggtaaaggtaaagaaaagcgtcaaatcaatggtaaagaaggcggtgacaaaggtgaaaaatgcattgaattcggaggatagaacaactgaacagatacctgttgaagcagttgctggaaaggaaaagtcttcgatgttagatcaaatgaatttttggtctacaaaaagacaagaggaaaaggctatccctgttttcacagaggaatcaaatgatcaagtaccaaacaaaatcttcgagaagcttcatctgcaagcattgaatcacaatgagaagatttcgaagttagaagatcatctttatgaaagcacaatgtcgattaatcaaaatgtctcaaacgttactagtcatcttgtcatgttgctagatgtaaaagtcaagccagatatcattgatgagatgacaaaactaattaaaaatgaagttgtcgaacaaattaacggcaaattagacactttaatttttcaagttattacattattgaaaaataatgatggtacaacaaatcaagaggacgaaattgcaaaagaaattgcaaatgaagaaagggttgagctgccaacacaagatgaagatgaggcgttaatgtgggaagctgcattacactttgccagtgagcaatcaaaggaagaacgtttaagaatgttgtcaaatttaacaattggacaaagtgcattacaagatgtcttcatgcaaattggtgattcaatgtccgaagtaagtggagatcaagttgaaacaatcgaaggtgaagcgacagcagttgagcaaatcaattcagtttcatcaatcgtaagttcgattgaaaaacaatccacaccagctgaggatgccgttcgtaactgttttggggatatgacttatgaatacaacaatgaaacaagttatctattgattgaagacagaaaagtgttcttcaaagttaatgaagatgacttattgttgtcctttgtatgtaagtcaaccccaaagaagtgtgtcaaagacattggtgaagtacttgttgaattcgcaaatggaaaagaatgcacaggatgcagttatcaatcttctccagagtcagatgattgggaattacttaaaagagtttcaggtcgattaaatgatcacattgaaagtgtgaggagataatcgtccgaatgacataataggaggaatctaataatacaaacatcgtcgtagtaaaagctc

SEQ ID NO: 712 - DNA, 1451 bp, Unknown
  derived from dsRNAs of unknown virus
gggaaaagaccctacagagcttcgcacaacggactccgactaggcttctcctggagggtgtcgcaactgagcgatctcctccccgaaaggaacggtacccaggtgcagagagactaggtggatagtctaaatttgaccggaccttcggagcccccagggcaagaactggcgaggtaacaacggttactgccaactgcacacccgacaccaacagcaggcgctctacgcttcaaccaacaggttagccaaagcaaagctgatagataggtccacccctatcgtaacaacatctcgaaggaggtacaaatatggaacaacggaaccaatctgatgatgaatggccactgaccaaggacgaagaacttgtccgcagttacagtacgcaagtacttaacatatatgaaacaaagttcggcacaaagtacggtagcttaaccaaatcaaagcgaaatatgctttacttggctactgatatggtgatcagtctctccgaagaactcggagtcaggaatgacatgctgcttaaaatcagcaagattttctctgatgaccttgatgatatgaaggagcaatcttaatgttagattgtcctgtttgcgatagtactgatatcgccatggtatctgaagtgatagaacaatctgctctatctggccttctcgtgcacacaacaacctggcattgtgaacaatgcagcgcctctctaatggaggtgtcagtttgagtaacgacgaagaaggacttagtgaaatacctgattggaagcataaattaatgtcgataatcagtcttcacctagctagtggaaaggaattcactacatatacgatccaagaagcttgcttctcggagaaaagttttcaaagggcttcgatcccttcgagacgcgcgatagcacgccacatccgtttggttggaaagttagaaaatacaaacattagttccgtaaccactaacgagagagaggaaggctatattaattccggatctgagaaagtcgtttatcaacgatcaatgacttacttcaggggattagcatgactctggtgacaccagaagtccaaaagttttatcttttgccgaaggcatcaggtaagatatgccttgcatgcaagaaaggtgaaatatttcaccacgtaggcatggatgtagacgaccatggtaggttgattgagtgcacagtcgctcgaactcttacaggtcggaccataggaaccgtctttcattcgagttgttcgaatactagatgtgactatcatctctccgtaaggaagagaagacaggatgatgctaacgctctgttccgcattctccaagacgtacgccaacgtggcaagtggcgatctggacgtggttccagaagatctagatagatcttagacaagtcccctagcgggggtgttccggttttcccggaagaatcctgaggattctgtactttacgtacaccc

SEQ ID NO: 713 - DNA, 1369 bp, Unknown
  derived from dsRNAs of unknown virus
gaatattctctgacgcaatatatatttttgtagaatgcaatacaacgcgatgactgaaagtggacaaagacagaggtatcagaatgatcgtaatgagaaacgaaggcctcaatatggtctcgatctcaccgcaaaatatgagcatgaggagcgaatgaaaacacacgagtccgaactaatggaaatgaaaatggcgcttgaaaagttatcgatgggtaaggataaaataccaatgttcttcgacccagatgatctggctaagggcagttatggagtccatattgataagtacttaggcaggagccctagtgatggtccagctggttacgttttccaaaaagtgacgtattcggctggcgccattatcaataaaagcaatgtcgcaggtatgtataagttgtgcccagatcatatgggctacatttatcatgaggggaacacagtgttaacaattgctactggtgatgtgaccactggtacggacaccattactgctacggcccatgggctgctggacggcgagaaagtcgtttacgctgccaacggtgacacggtcatggctggtctagcggatggagttcaatactttattgtgaataaggctacaaactcgtttaaactcgctgctacagcaggaggatctgcgattgacattactggtactggaaattcagcacaaactttaacggtgagtaatgaagtaaggataaaccaagatggagccgatttgagtggcgcttcagatccgacgccatccggtatttctggtgaagcgaaactggttccaggtgatatgatattaggagcaattctacaattgctagataccagatcttctgataacaggacgggttttgtcactgcaggattggtttcaaatgactcagctgtcccagattcgtacggagccgaattggcttctgatccaagcaattttatcacaggaagtgccattagtggcggtagagtgcatgcggcggctggtttgaaagcttgctccgtggcgagcccgaacctaaacatttacagccctacagttgttgctaccgctcaaagtgatctatcatctgctcaaattggagctccaattaacgcaatcaatgtttcaggagtacaattaaccgattcaaatcaaattaggtttgtacttaacgtgtacgcacttgttggagcgagacagaaaacgatttctcattacacacaacctgatccagcatttaaaatggaatgcctaacccgccagtttgcggagcaccccgtgtctatgacgcactaaaaagtcaagttataattttacatcatgcgaaaatgatatacggcctctaatgcggtttgtcaagccgggttcacattaaagagatgaaacatc

SEQ ID NO: 714 - DNA, 1213 bp, Unknown
  derived from dsRNAs of unknown virus
gaatctgaaaactactaataacttgtaacatggagaaagtcgacatatcaaaatcaagcaaggaggtgaagggcgcgaggctacatagcgcagtccatatcacagccgcattgaagaagttgggcattgagcttactgacaagccacaaacaattcgtctgcgcgagggaaaggtccttaaaatcaatggttcaggtgtctccattcaagctgttaagcgtgtatttaatgcagacatcctgaagcgaatgtttgaggacaagatggatgcctacctcaaggaaggtaagcatgtgcccgggcttgaattgctgtttgtcgtgagaacgcacaggcatccaactcacatgattgaacatgttaggaacaatatggtcaaagacggtttcctcattgacgggttagagtatgcggatgtatttcagcaattaatgctctatgccccaacatacatgagtgacaatccagacaattcgtgtccctatctgtttcatcatgggaatggtgacgtcgcaaagaactggtatgagaatacagttacgtccaccgaaacagtgaccagcgacgatgactcatggacatatgatccgttgtctatggaagcactggagatcgaggaggagcaagcggaagagcagcatgataagcatgtgagaatgctggaatactatggagacatggaggattctgcactcattcccacaagaaaggagtccttcatgcaacttcacgaatggaagagtactaagaaggcgacgccagaggaaacggccacccccccaccagtaaagtgtgggcatactgtggttcaatcctggagggacatactcggtatggacatcatagtcaataaacggatgtttaaaattggcgatgacaagtttgcactgcagtgtgcccggaacaacttcctgccagaggaggaagcattcgtggacatgaagttaaacaaactggtcactgttgtgaacgtaattaatgtacgaagtcagcccaagtcttcaaaatttgtagacgtcgtgtatctcatagatgagatcagatcatataacacagacgtaatcgactgcattgcggtgagaggtcaatcgggagatgtgatcagccgcggcattgatgcgaccatgtgcttattgaacgtgctacgtcagggctattaggatacccagcaacttcggtgtgctatgagtacgttattagtttttagaacatc

SEQ ID NO: 715 - DNA, 1376 bp, Unknown
  derived from dsRNAs of unknown virus
gaatctattaccattaattcaacaaacgagagatgagtgaagctagtgacgctacaaaagagatcgactatgatcaggcagccttcaatcggctggaagcgcttaataaaagtacacttctagccggttcccgagttgcattccctatcgtacaattcgatgactataccggagcaatgttgaagacagtgccaggattaacgggcggggataggaagctagccggacacatggcggacttacgaggaacagtatatacgggcaatcccaacgacgatagaactcgaagacgcacagcccgcctcgcaatagccagcacgttaatccaacatattgaaaattccattactggaacgacagcctacacttcaggagtggcaactgttgaaacgttatccgaacttcattttgctctacagcgtgcagaatccacgtttgacaccttggttaaacaacacattggagatgatggtgcagatgcagccgtgagatttctggccgaagaggacgaaatcatgacgctattagcagtgttacgatcaatcgtaacccttttggatgaaaacaatctcgaagaaattgacactaaactaaccgccgcggtaaacgaaacgcgacaaatgctgagcgagactgttaatgccgtactagtacttaggcaagctgcgatcaatgcgaatgaaccagataaagaaaatgccgtccaaagttttgtcgaacttattaaaaacataaggagcgcaagcgggactctattgaaggggctgacaggtatgatctccagcgcgatgacgcgaagatctcaacaattagacagaatacgcaataatgctatgaccagcaaggataaagcactaattggcgtgttacaaaaagttgttgcgaaacagagcatgcaaggcgaggaatcaatagtgcttgcagtcgacatcacccatccgatgttcgagtccactatggcatcattacaatcgcaaaatcctgtagtaccaatcccgatagaaacggaaactgacaaacatatgatttacctagtatcagaaggcattaccaccgctgaagcactagaacaacgatatggcgatcaaaatgtaattggtagcggtacaggtttgaattcaaccgtcgacgaacaactgttcattggcgatctggactcagacctgttacgacaaattgaactcgtcaacaaacttgttgaactcgaattggacgtgaacatgtggcaacttttgagtaatgagcggttgagctcgttcgtactcagattatttaacgcgactaatgagaacaagaacatgagtttactcgagcctttgaagagcatactgaataaggacgagtcaatctaatcctggaacatggtgatatacatc

SEQ ID NO: 716 - DNA, 1178 bp, Unknown
  derived from dsRNAs of unknown virus
gaattattcttcccatttcaacatgtcctatacacgcggcacaccccaaaggatcgccgaatatgctgatgaagctattgagagtatgagagtggtaattacaccactttcaaacacgctatcaataattggcaacgcaacaagcttcgacatgatgcgcgagcaccttctcgatcggaaattcgacagggtattccacttgatgctgtacattgaaacagcaactggaatacaatctgtggaaagattggatgaagttcacgtagaaacgaaaccgaaagtgaaaacagtaaccccatttggccttggtatgataatgaggaatctagatggtaagatattcgataaggagttcatgccacaaatctcagacacctcaatgtcaatcgagctaccagtgccagataggctcaaattcggtgctttcatggacaaagtagagctgactgaatacaacatcgtacgagacaattcccagacatttatcgctaaacttctcgaagctaacaagatactgagcagccaagttaatgcatggataaatagagatgttaaagacatcataagcggtgactatttagctaatatcacgcacatcctattagaacacggaatggttctcgccccatttagacaattgaacactagcgcaccatccatgcaatccgaaggcataaacatgattggtgttccaccaatcgaccatatgccattcaagcaaggaaaaaggatagcactaatgaacaaacccttcatgcgtagccatggcagaccgattcacggttcggatgtagatagaccagagatagatgtaatgttcgcacgcaggaaaaagcgcatgaaaggcataaatttcaagaaaattggaaaatcaatcgctaagataggagctgcaacaataactggagacgtagccacggtagggaccaacgaaatactcaaagccgttggttctaaacagcgtgtacctacaaacacggaattaattaatcgtgggttagcggctgtaggctctaaaggtagagtaccaggcaacccattattgaccggtgttatagatagaggcggcataactagcgatgatgatagggctaagacgatattctaacgagatcttataccgcatttagtcatgatgcttggccatcatgagtgtatgaatatagaagataaacatc

SEQ ID NO: 717 - DNA, 1194 bp, Unknown
  derived from dsRNAs of unknown virus
acaatcgaataaggaaaacttattcttttgtacagctaggtgaaaaagatgaatgatgatgtaaccgatgtcgggcgtagcacgctcgtagcgatggtcactttgtttctacaaagtgtcctgaaacctttgaataaccgcaataccgtgcctgatattagacagggacttggtcgagcgttaatacacatttgccatacggcattgactattaactccttcggccgtatcaacactgatgattctatcttcaattgttgttcgtccgctgccttttacaaacgcaagagtaatagtttcggggtctctggccctgtaaacaggaccgatcactttggtctgacttttgcgggtaacggccttttctttctaggattgtaccatgcgatgagtgattttagaatgcaaacagcaagggctattgaaaagttccgcgacgacctcgcagaagtttttgattccattgactatgcactcagtgaatttctttcagatatctctcaagttgctatggttttggagcgacacctggtgcaagccggcgtcgatccgatgctcctagaaaaggacgatcgtttagatttcgattccctctccttcgaggtgtttcagaagctacatgatctggatttcgacgaggacatacttgagattactcttgtgagtaataacttgtcatgttgcccgcggtgtcaaagagatgtcaggacttacgacttccctgagttgggggagttctacgacatgatggacattccatctgaagaagagtaaactgttatacgcagtttgtcgtatttatgagctatgagtgtgtcgcgatgtcattccccgtctaggcggtgtatcatcggatcttcacaccgaaactggtagacattgacgagaactaggttcttgatggccttctacctttagccctaggccggggcaaaactcatgccgctaatgagtataatctagcgaggacgaatacatgaaaatagaagtagatatagatgaggacggcatccccgatgtcgtcaccacagtggatctcaaagctatcaaacgtgctctaatacttaaacttacctccataggtgcagctgttgctgctgtattaggactcactatgctagtttgattcccctaggtggtgtgtgagtggccacacaccgaaatggtgtctccttctagtattctttcttacct

SEQ ID NO: 718 - DNA, 1267 bp, Unknown
  derived from dsRNAs of unknown virus
gaattattagaatatgaatgacacaaggagtacaggtctagcctcggggccaaatagaagtatggctacaataaaatcgagtcttgaagcatcaggtatggacttcactgaagcagtgaaagtcgggactgatgcaaacaataaagatttaacgttaaaaggagatctacttggtagtggagctattactggaattgtcggatctttccaaagtggtaacattgttctagatggtgacggtgtgaccaccccaagtgtacagactgtcctagttaccgtgtctaaagaccaagtaaacaactcgacagtagacaaggaacttgtaactaaagaatatctgttggcactaactgctgatgcagtcaggacttcagggaactcgaccataggtggggtatacacatttaatgctctgccagtctcatctgctaaccccacaggtcttacgcagctaacaccaaaggcctatgtagatactgtagttgctactagggctgcactaaccggttctacatcagtggtggtgactaaagatcaaacttcatcatcaccaattgataaagagctggtgacaaaggaatatgtcacttctgttaccccatcttcgggttcattcttaatacttacaagtgatagacatagtggtggttttgtgtccttagagtcactaaaattcgatgtgaatggtatcaacataacagatattcttgtaggtactacaggacagttcgttagaggcaggggccctagtcaagtcgggaattatataggtttacattgcaaaagtggagtgtacaaagtgacgttaacatataacagcgcgggcgatgctgggctcaagcaatccatgggtttcgacttggatggtaatggagtgatacattttaataatgttgacgcagaaggggtaactattgaagagcagtccaatagtggacaacatgaacgttctcatgttatcccatatgtcgtacctcgaaatagtatgttctattatctggcacagcacaatgcatttgcagttgaagacgatctcaattcagctttcactctattaatagaaaggttaggagccgcgacgactagtggatcggataacagcttcgctgcatattctggtgcagctacttcaactacctcaactgtgtcaataggcactctcatagattaatcatttgaccatattttccataaccccaatggcagacctcaacttctatcacttcccttgccaggaaagtttcacttcataagctactaaatgctc

SEQ ID NO: 719 - DNA, 1165 bp, Unknown
  derived from dsRNAs of unknown virus
gagctaagaacttcctgcagctccatacagaaatcctatcaacacccccctcaatctggcacgaaagaacaccgctcagaatgggggagtgccggctaggtctgcatacctgacgtgttctgcggcaataatagagacacacgaatcagagctttgcggtgttatccaccgagtttcctcgaggtggctcgctcagctatcgcactctcaatagaccttgattgtggtcgctgtgatcatttatgagttttggggaacctgtcaaatattccctatcctgcctacgtagaaagccgttaccatacccgcatattttgattcccatttaaaccgcttttaacggtaccacaacaccactactatctcctggtatcatggccagctagccgagttgctaggtgacgcgccccttacctccacaggttcggggacccttctttgtagatattctaactcacccggactggatgacctatctacgactgtgacacgccagtgtcaacactcccccactttagctacatactgcatttccttaccagattcaaaggctgagcttccgagactaaatttgtcgcttcccctttccaccaccgcctggtcttttggaacaggtttaggcttacgttcgaagtcactcgcataataagcgtcttaaataggaataaaatgactaatacccaggaacaacctggtttccaaatcagtgtggcttttctgctaccgcttacaattgcggaagtaatcttggttggtacactctgcagcgtaaataacctgaaccggtcataggtttcatccctagtcagggcaaaccgatcaatctcctacaaggctattccctcgtcttagctttaagaccactacttttgcatgttcgcggtcattttgggcttcgattcgtacctcaggtccaactttaatcgtgttggagattgttggccatggcgggggctttgcgttttgcgctgggtgcacttccgatagcgacttacttccatcggtcccggaaagagtatcactccttccattcatttccacttatatgtgacttacggccatgacacggtgaaactagtcaccggttcgtactgagtttagacggcttagagctgtcctccctcatgtgggtgcaatctaaggagatctctctccattcaattac

SEQ ID NO: 720 - DNA, 1241 bp, Unknown
  derived from dsRNAs of unknown virus
gaatagataacccgaaatacattactgtaatacgctcatggaaggagagagcgaagagtttattgtaccaccccatgaaatggatgaggttggaggggatgtggaactgggggttcaacccagtaaacatcctcgtcgtggctcactagtagccatcaacagatccaccgaatgggaggcaggacaagaaagattagattgttacatgcgtgaggttcaatggttatatgaacgtatggccatatgctaccgcagttacgaaaggagtcaaacttggattgagattccaataatcatattttcatcatttgttagtgtacttgtggcaggcggttcgtcgtatataccaattatggtattagatgtaattatagtagggttatcagtcagtgtcacaatattacagtctatacgtacattcttccaaattgataagaaaaaggaggtgtatggagaggctcttaatacttgtgaccgtctagcattacgtataggcaagctgtactcagtatataatagcgaggtaaataggggggtaaaaccttcaatgaccttaaaagatattgatgatgagttggagcttgaaatgcacactctgttaaaattgcagcccgagagcccctctgttatcacatccctgagggacaggcccatggtttcatctcatgcccttaaaggtgctaagttgaaagagccaagttcctcatgctgtggatgctcacatgacccggatacgtcataaaactatccccctcggcctggcatgccgtaacaactgctatacgctataaatgtatggtgtacctaaggtacttaaagaaagctattgcgccataacaagttcaaacaataaaaccatacataagctgtcaaagctaatgatactcacaaagtgtgtaagggctatgccctattataaaaatatatatatggataagaggaggcacacatcaagtggtgtgtgaaacatcaaaatatacttgttctgtcaagtgcccgtcgagggcaggagcaagtgtatatcttaaatcttaactgtggctggagtgggtcgttataaagaggtgacatacgtagaacgtgccatggcacaatcaagtacgagtcccttccacttccctcaaaaatgaacaattaaacagagacaagccaatctcaactattagcgtatgcaagtaacgtgcgtcatcccttgccaggggacggtgcgggaatggaccttccattcgggtttcttgctc

SEQ ID NO: 721 - DNA, 1234 bp, Unknown
  derived from dsRNAs of unknown virus
gaattaatctcgaacatcgtaatcagcgacacaatgacagaaaaggagcacgacgaagaaaaggaaatggcactggctatgggagcaccaccagactatatacgctatatgcgaatcctacgtaagtgggttcagagtggtagtccaggtcgtagggcaccggtgtcaccgccggcaggattctgggactggtatatgacgactgcgaacactgatgacggtgcacaccatgcatggggtccattagggttattatcatccatgcttgcattcgcaccattcccaggcgcgcgagtcgcggctgcggcattgggaggtgtgaacgcccttatagatgcgaacacaccgcaacatgcctatacagatgacaaagacattcacatcgatgcatttgacgtccataatgggacgctcggcgctaagatcgatggtatggtcgggactagtcctaagggggcgcctgcaggttttgtactgcggaagcttgaatatgaagtgacaccaggtgcaagcgacttcttcgttgccacgtataggatgacggaccgtcacatcggatcgttactaacgaagaacggagcgacaatcgcggtcggggtcgtcaacaaggatgcagctaccgccacatcaggtgaatacgctgcaattgcaccccaacgtgtcaaagatggcgatatagttgtcgcaaccatccttcgagtgattgatggtcgaccaaatgtggaaaaggcaggccattttgctgtgggattagtcccatgcgtcgatccaagtcccagtgctagcgcgcactatggagcattcactggggatgctccatcaacatcgattattggtaatgccatcggcggttcagcgcgtgtggcagctagcacagttcagaagaacgtggctatagtgcaagttgccgaggatgcagcctatttcaagcatgtggatagggataccgcaacaggggcatataaggaggatggcgttacaccaattatggcaatcgcggcggagggttacaccagcgcggacgcagcaaaattccgtgtgttgatgaccgcatacgtcctgtgtggaccccgtgatgaggaccattcacacccagggaggtccaggagctcccactcaatgaagtgcttcaccaatctagttcagaattctccaatttacattaagtagttgatcacgatggtgcagatccagtttgtcagactggggctcagctgctagagatggtaacatc

SEQ ID NO: 722 - DNA, 1194 bp, Unknown
  derived from dsRNAs of unknown virus
gttaattcacagaggggaaacctgtcctgtgagttgtatcggcgagtcttgaacggctcttccggtattgtgaatgatgtccttggtccgcgtgcggagctaggacaccttggaacatacgagcaaagtaagatctctacctattagtaaggtttaaggaaggagcgtgtcagcaaagacatgtgacatggacctcggggctgtcaccctgaggatactgatccaccgcagagcggaggaaggacctggagagtctgaagatacttgtcaagcaaccgcatctcgcaacgtccccccagctttcaccgcctcggcagaccgtggtattggcattgctggggatgcgagctctccggtgataagatacttctgcgcaaccgcgttgctgtcgggtcatcgtagcccattagttcctcgattcgtttcggtcatgcccatgcgttgaacaccgcgtatgaagtatgaacccagttcactcgtgtctccctgtttgctgggggtacgatgcaaccacgctcaaggctgttcatagcagtcctgtttgaagccaggtcccatctggtgatgtattcccgagatacttgtatcgctaggcacgctaactgacccgccctcatagctaagtgagggggtgtggccgctaagaatgtgtacgctaaagcgtaactgaaacacaaacacgctaaacatggtgctatactatccactgatggacaaccgattcgcaatcgcggccaatggcccagctaaaccgctggagaccgtatgtgtataaatgatagccttactatggtaacagtgcgggattcgattcgcctggtgagtcaagtaggggttcaagtgggatgggaggcgtgttataagtggatgcaaacctatttgtatggaaaactgagtagcaactcgattatgcctcgtcggaggaacagatcgtttgaatgccggatgccagcagataagtcaagaacaaaggggacggtgactaaagaccactgaatactggagggacgggcgagtctgaaggactaagggagcctcgggccggggggtagaaatattagggtccacttgtgtgtaggtatcgaagcgtggaaaagtatacagaggtaagtcccaacacccgtatgggcatctaaacaattcacggacgagaatgacgactctttgctatcgcagaggcgaggtgtctgactc

SEQ ID NO: 723 - DNA, 1076 bp, Unknown
  derived from dsRNAs of unknown virus
gaatattagaccataactaagttagtgtttaattaaaacatgtcaatttttcatgagtacaagaaagcatttgaattcggatacggaatagggcatgacaagttgggtccagctttatcaaaagtgctagcagcagacgatgaaatggacacaaaagctgaaaacatgagaatcagaatggaaggacagctgcatttagtttcattaagaaacgagcaaacacgacaactgtgtgcaggaaggatgcctggattagaggaacacatcggatgttcagttcaaggctatccacctggatatattattaaggcgtttgaaacaacatatacactatcgcaattatcaacaagtaataatgttgacgataagagaatagttttcgttaaaaacatagacgaagttggacacttaatgtcagcacagtacttttcaggtaacaaccccttaacaaatgttgcaaagcaaaacacctatcctggactaacggaagcaagacgtccacagcatggtgactacttccttgccgcaaatcttcgcgctagggaaaacttttcacaaaatgttaatgcaggtaagtttactattgcatttttgccgctgaggagcaatgaacttaatcaaactgacggtatatatgatgtacttacatcagcaggtgttgaagcagagatgatggcacaccctgattcaggggcaatatcatttaatagttcaacgtccgtagcagttgctaccccgcatatttaccctataatgatgacaaaagatccagcagcaaccgcaagtggtgcttctgctcttaatacgttggtagcaaatgaccctaaaacaagaatggcattagtcattagtgctgctgggtataataatgctggtggagttgtaaatgttcaagtcacactcaaagagtattatttatctcctccaagtagttccggacttgtgtcaacaacgtctgcaagtaacaaaattcacatggatgaactcgaaagactatgttttaatcctataaatatgatttagttcggttgccatatatcaagtggtgtgctcataaccaggtcttctcaaagctc

SEQ ID NO: 724 - DNA, 1069 bp, Unknown
  derived from dsRNAs of unknown virus
gaataagtaaccgagtagttgctagcgtgttatggtcaattcgacttcagcaagagaaggaaccagctcacagtcaaacctaccagtttttggtccaccacgacaccccttggcgggattgagatcagtgcccagtagacgaattaggtacatatacgacaacccgatttggcgtgctaaccccacaattggaccgattacgcccgagaccgtgatatatacggacggtggtgagaccagattggtaaagagacaacgtaggatttaatgacaacgcgaagaccatccgtagtgacgccaaagcaatttaaccagcaatgggaagcggccgaaataatcttggagcgcataaagcattcgtgttataggagtcatattctatataaacatagatatcttgcgtcccgggatcgtctgacttacttcgatgtgcccattattgtattttcaagtgtgaacagtgtgctgattgcaggaggaaagaacttcataaatgaggacatcatagagataaccacgtgtatgttggcacttgcaactggcataattcaagcgctaagaactttcttcaaggtggacgagaacagagagaattgtctcactgcatacaaggatttatttagattgttctgtgaaatatccataatcctggatcaaccacgacagactaggggggttgacccccagaaatttatggctgataaatccagtgagtataaggaaataatatctagagcgatagtcttggaatataagaaagcagaacgtgatccaatataccacgaccgtcatccctggatgaagcagtacgatatggcgccagaagttggaacacctaagtcagcaccagatttcgaacttggatcgtctgaaaaacgacccatggacattggccttccattactaagagaagacagtgttgaaataccagcgttgaaagagcccaccgattcttcagaggacgatgagaccgatagcataccacctgacggcgtacaggggggagcagctgggtgacacaagctttaaaactgtggatcccgacacgcacgaggttatggagaacatc

SEQ ID NO: 725 - DNA, 962 bp, Unknown
  derived from dsRNAs of unknown virus
gaataattttgtaggtgtcatatcatatgagcaataacgaaataacaagcgaagtaggttcaggtggtgtcagagtgcgtagtataagagtttcagcattcgaaacagttccatattgtgtattagaaacgttgggttcaaatcgatattttgataaattaataaaatcaccacatccaaaagacattcctattccattctttgttgatgtcagcgaagaagggaaagacgatcgtaaagagatcggatcccgcagaggataaggttataattgagtttgaagagaatcaagaagaattaattgatctcgttggtgacgaagtatcaatacctgaggatgactttgatgatagtcttactattgtatctgatgttcctggtgctacattttggagtaatgttgataatcttcttagggcaattgggaaagatacaaagatacaatcaaatgtcttccaatcagaatacaagcgaatcattcagtatcgaatgttgtttggcgttccaattattattctgtctatcgtctctgctgtattagctgcaggaggactgaattttatacctgatgaaaagtcattagcctatactacatgtggaataagtgtgttgatttgtataattcaatctggaagaatgttaattaaaattgacgaaagagcagataattatcaaacaacatacaaaaacttacaacgcctatacattgaaattgcttcaatacttaaaatgagtagacataataggacttcagaacctgatgctgtcaaggcaggagtattaaagcgatttcaagatataatggaaaatgccatggaaccactttcttttggtcgtgaacttgaaacggatcacatactaaaagttgaacgtaagtctcatgaaagtgcttaagtcgtaacaagcgcggtatgacgggttgatcttcacagtaatgccttcaccttacaagataaaagctc

SEQ ID NO: 726 - DNA, 988 bp, Unknown
  derived from dsRNAs of unknown virus
gaatattttcttactcataatcaatactatgaattacaagcagcataatttttcagcagagataccatcgaccctcgggcattcactccaagagccaggatggaacacagaacaacacatggtaaagcaactatccatcacaggagacggcttcattatgtatgtggacatgcgcaagcatgtcccttgtttgacgttgtacaggatgagcatgccagggggcgcagtctcagagatgaaggtcgattacgttccagtactcgacgacgactctctgagccagggcagcccacttggcaagcagtcacgcgccagtcgtgtggcactcaactttgaaccagaaggacaaagtctagtaatggagccgggatcaccccgtcctccagcacttcccccttcctcaccctgtacacctgaaaactcaaggcatggccagtatgaacatgatgtgtcgaatgagaagaaactatcccaccctagcctagctgatgcaccatcagaatccgaagcgtctagcagtgagatagatatgtcagaagtcccggacgaagtgataatcccaccccgtcttgttcgtgacacacgactcgatgtaggtcccgagaccgcatccgagtgctcctctttaaccgtcgccgctccatttaacacggacgacgaattttcagaacttttcaaaagtcagttcggcaccaccgcggtgctaacttctaccggtaccatgaatgtcgctggatgccgcatctttttgaaacgcgagggcacgggacgtctagtcctgtacgccgcgaagaaaggatcgcggaagaactcggtacatccggcaagtgtgacacgtcacgacgtgattactatcagccccgatatacctcaggacattcccaaatcgcctccaaaacatatacttgcccaactcaacgccgttcacggtgtgttggccgcattccagtgttagaattgtgtgtacatgagtaagttatgaaacatc

SEQ ID NO: 727 - DNA, 965 bp, Unknown
  derived from dsRNAs of unknown virus
gaatattatacagtatagtgaaaattgtttatttgcatgtgacattaagcttgacatggttcttgatgatgacgttgatcatatcgaacttaattcggaatgggaggctacagaaggtgttcttcagcgtcttaaacatagctgttttgctatgcaccttctgtataggcgtcgttttctggaagcaaagcgtaagcttgcttactacgatgtccctattattgtactttccgctatgaacagcgtacttatcgctggtggaaaagactttatccctgcccagatactacaaattatgacttgcctgctagccgtcgcggttggcataattcaagcaatcaaaaactacttcaaaattgacgaaaatagagaaagttgtctggtatcatataaagatttatttaaattattctgcgaaatttcaatgctactagatcaaccacgatattctagaggtatggaaccgcgaaagtatactattgacaagggtaatgaatatcaaacaataatgaataaatcaataatacttgacgataatcgatctaaaaggaatccaatatatgaggataacaccccctatattgcgcatcgaagtggaatatctcaacttttccatgatattccaaatagtgaaggctctgaaaatgagttccggctatttgggaggaggaaaaagaaagaaagcatgaaaactactgaaagtatgactgacttacagaggtctccatcattactacctgaattagagataattgaggaaaagattgagccaccaataactgaagcagcggaaacacaaacaacagcagttggtatcttcatacgagatgacaatgaaattaaatcaggatctgagtcagattaatgtaatgtgaatgaaacggaagcgatgtcgacgtaaccgaatcactatgttatgccatgataaaacatgcataatatcatgttgctgtgtatgaaacatc

SEQ ID NO: 728 - DNA, 972 bp, Unknown
  derived from dsRNAs of unknown virus
gaattattaccacgcaaatcatgtctacctttaagataccgcacatggaaacattcagcatgcaagcatcacattctgagccaagggaggcggataccacccgtgtcacggatggtatcttcccccacctagaagataaaatagggcaaacaccagttgggtacaatggatatagagtaaagaaaacaatatattccaaaaatattcaaaggggcaattcaggcgcagcagcaaccgacgtattcacaaaacagcgaggcatatttacattcaaaatggaccgctgtgctcgaggcttcatggcgattaaggaaacaaaaaccacctccggtggtacagtatcaaccccagcgggattcgacttcctaaatgaagaccaacaggggggtgaccagtcgaccggattatcaaacgggaacagattaacagatggtgacattgtgctcggcgcaattctaacagtacaagataaccgaaaggaagataataaagacggagtgctatatggtgggttcgtcgcgggaaaaactacagtttttgacgcaacatccatctatggacacaccgcagacactttccaatcggacttaaatacattcagaataggagcaaaactggagagagcatgttcagcgacaacccgcatgtctgtatgtcaattagcgcagaaagatgcgttatacagattttcatcggttgccgcagatcaagacgccggagccccattcttgggcgtaggaattgatggaatagtcacgtcgtccgacgcaatccgagccgagttgaccatatactcgctagcagcaatcacagttaacgacgccccggcaggatcatcgtcaaaagccacattcaacctggatgacatcacatgcatgtatgtaacagataacgtatactacagttaagaaatgatcagcgtatgtccattggcgtcgtcaacgccaggctcatagacaaggtataaacatc

SEQ ID NO: 729 - DNA, 966 bp, Unknown
  derived from dsRNAs of unknown virus
gaagatcgttcctcgtcagattccattgtacgtagttatggagtcccactccgtgcgtgaaattgcgtacttttctcatggaatcgttgttgtcgtgtctttgactggacccgaggccgacaatacctcaacttataattctgaatttgtcgtttttgatttatctaacgtcccggctgagtatctcagtgataaacaggcgagtcgtgtcgctgaaatgcagcttagcgaccatgttaaaataagtatctttggtagctgtaaaatcgagtataatgttagcaccgtgttcgccacggtgccacttgctcgcaaaccaccagggtactctaagatatgcgtcactgctaaggtgctcgacgacccctctatggttgctaaaattgccgctgaggcttcttcatcaatggctcctgtagattttgcgaagatgcccactaagcggataattgacttgctcgatcctgatcttgactctgtagtctcgaggagaagttgcgatgagctccaggcggtgttggacgccaatccaaccgtgccaccgccgatgccatctcctcgcttaatgactaaagtgtacaagaagactcatgtcgacccaaaattcattacatacatcaacgagagataccgcgaacgttatgtatctgaaaaacctgttgacttcagcaatcatctaactcgttgctctcgacatggtggcctcgtattcaccgtggatgatgttgtgaagtatgtgttcgttgataccgcgaacgcaaatggcatgatctccattttggacaagccaaagaaatcatttactcctcttcatgaggaatctgacatatctcagtttagcatgggctgccgcaccgtgtcggacgaagcgtttaaacagttggcttcacggttcactatcgtgtggctaacgagcgctaaggcctaagttgagtacatacgtctgacgatggaactagaaaactc

SEQ ID NO: 730 - DNA, 955 bp, Unknown
  derived from dsRNAs of unknown virus
ggatttgaatctaagcatttatcgcacaaagcattacaatggagacatataaggccaaaaatcaaaaacaaagaattattggtgcgtacgtatttaaggttggatcgaatggaaagatggaattagttgaagagaaacgaggtgaaggatttggacctattggaggtcgcgcgtcatatatggatgaacgtgatggtgtaggtatccgtggtgttttggcacgtgaatacgtagctgaaactgggtcattattgcctagagatataaacttaacctatctaggtgtgttttatgatgagacagaaagatatcgatatgagaataacatatacattcttatgagtgacgttcctctatcaaaacacagaatacgtcagtttgagattaaagatttgctgtcacctagagatgacggtgttaaactacgacattggtttgtgaaactgttaaagaatgatatagtacgtgatgaattgatgggtgtagtgattaggaatggaattaatctactaggtacgaagctaatcacctcggtatggtatgtttacgtgtttcccgagcataacccaggaattaacaatatctacagaattagtgtggatgtagaggatacagatgacggaatgaagattaattatagacccaaacgagtgacatggaaagtagtcaatagtgacgtgaataagtcgggcaatgcactaaggagtgcttgtctcgtaccacgtgcaatagacgaactgcgaaatagaaatttgaatactaatattgtcgatctagttaatacgttaccaaagaaagaaggcgaatcgagtgacgactggttgatgttcccattgcatgagtacttcgttgccgatgcataatggaagtgttaatatatggagacgcccaactcccatgtataaacgtggaaataatggttgactatgtggatgcttacctttataacaatacc

SEQ ID NO: 731 - DNA, 932 bp, Unknown
  derived from dsRNAs of unknown virus
gaattaaactcctgactctcgagaaacgaaatgagtgaaacggagcttacttcatctctactatgcccaggagaatgcgtaacgctcgcacgcgatgttgcctgcgcacctcccgatttcctggaaaagcacggcgctctacttcttactataatgacggctgtaggtggtgggataggtgcactgcttgtgtactgcctgaaatcgcgttgcacacagattgatctatgctgtatcaaactaacacgtgagccagtccctgtcgtggagctatcttccatatcacaggaatctgtcaccggagaagcggcagtgccgggtccatcaccacccccatcaccatcaagcgaggatcgttggaacatggatgacgcaatgctagcactgaacgagatagtatcggtgggtgaagtgcagtatgagcttgcttttaaaggtcatctcccttattaccccgaagacgaggaagacgaacacagatacccgcctttccataagacactaatctctgaaacatggacccaccttggggaagagttctggtggcgttcggacccgcgtttcgatatggactccagtttccggactagcttagtgccaccaacgaatctgaagtcgctaccaacacgtaggtcgataggcaccaacacgccgggatctccagaacccgaacaaagtcgccatgtaaaaggctcaggacgtgtcatcactctcgaccttgaggagggcgagaagacatcccgcggcatggaagcgcagagcgacccggccagcaacgacttctttccggcaatcaatcgagattttgaataatccgtacctcttgtttcgtgacccatcgtgacggcgtaccccgttacgactcgtggagtgtgattgtgccttcttcgatgtgcgtgatcacattctttagtcagtgggaagaatacatc

SEQ ID NO: 732 - DNA, 924 bp, Unknown
  derived from dsRNAs of unknown virus
gaataattcgtcccataagctaatgagcgaatttgaaataatggatgcggcaggtggaaatctacatgcaacaagccactatgcggcgcacacatcttcggcctccttctttaacgagtccgacttggctaacggctcattcggaccggaagtggagaaatatttgggaaaatctcccatcgatggcccacctggatacacttttcgcaagatcgtatctactgtcacggcgccggcgaacaaagcaacgatcgccgctgtatacaagtatgatgcaaataatcatgctgttgtcaggtctaacgacgacgctgttgccgttctcggactcgcacaaaatggttcaactccaactaacaatactttgttacctggtgattacgtgcttggcgctatcctgcagcttactgatggtagatctgatgataaaagatcaggcaccatcactgcagggctagcggcgaatgacgcatcagccctcgcaacgttcgccaacgatattgtagatagcccatcaagtgcgatttcgtctgtatccgttggcggcgctcgtaccgtaagcgcgtccacgaccagacaattgtccgtgtgcaccccaaacattaacattcatatgccacccttggttaacaatgacgccgaagtaaactatacttcggctccaatcctagccattaatatcacgggtttctctgccaacacgacggagaattgccgtggtgtattgacgcagtacgcactatgcggaccacgtgatagtggtgttgaaagtgtgtcggcctacgacccagaatttaaactgagttgtctaactgcaagagtagcaaaacaccccgtatccgtaatttaaaatcaagtaatttatgcgtatgaacattgcccgcatgtcaacgcggggttccgcaatagacgaacgaaaacatc

SEQ ID NO: 733 - DNA, 910 bp, Unknown
  derived from dsRNAs of unknown virus
gaatattgaataacgaaagtgaacgaactgccgatttttaattataagtcaagtcaaattatgacggccacaaattccctaaatgattacgttgaacgtgttagaaaatggaaagctgaggagtataccgacgcatccactatcgcgacaggaatcgaacgcgctcgaagtgtaatatccgacctaatgagtggggtcacgcccgaaaacgttgaggggttaacgtgggccgttagtgaaattggaactaccgtgaccgaagtacgtaaagccgtaatgcagtgttctatctaccaagctgcttctgctactgagcatgcggctatggcagtaatatcagatgaaattttcacagcgctatggcatttaaacaacgatttactaagtgagcgactcaaaatgcttgacacacgtagaatgtacatgcgtaggcgtgaaactcgcaatatcactagcgccgctgtagagacgtcattcatgtttacaatgttcctaacgaactacgaagtgcttgttaacgcaactagtgatgtagttcgaggcgctgcaaactggcatcatcacatggcactaatgttcgatcaattgaccgcagcgcagcaatatgatccggaaatgctagatgaaggtgacggaatttttcctgccccattagatattgataatgatgatatgccaaaactggaaaccattcagtccgatgaaactgatccattaactgagtttgatgatattgaggtgactagtgaattgagtgattcaagcaacggaattagggcgcaaaccgtaaacgagatagtaaccgaactaacgaaagttaaaagtccaattgacgtataatagaatttgatacacattttaattccaggggtgtctcccaacttgtcacttacgttatacatgtaacatc

SEQ ID NO: 734 - DNA, 775 bp, Unknown
  derived from dsRNAs of unknown virus
gaaaaagaaagaaatagagtaagactataaaacgattggggtgtgagcagcgctagcctccccgaatatcgagttcattggaacattggtggacttgttgaaaccagaactatgtcggcatcactcatgctagaggcgaagaagaggagagaagaagcagcgaaactatcaacgcgtgcatcagacttggaaactaaagcgacgtcggggcgcagggtcagctttgctagcaaggtgttgggtacgctaggatttgctgtcggtgcagcagcagcaccatttactggtggtacaactttagttgcaggggctttagctgctggagcaggcacgggagctttgggccatgggcttggtgaggcaattgattcagacgcaaacaacaacgtatccagagcagataaattacgccaaagagcccgtgagttgtacaaggaagcggatgaactggaaagacaagggcgtgcaaaacaagcagaggaacaaaggcgtgagaggaagagggaagaagatgcgaatacggcggaaatggcaaaagcggtatccgtgacggtgaactctaacaactcgagcgaaaccgtagatgggaaaagtggggcgttagacgaggcgagaacatttcccgtcatatgttgcctagttttgtaaatactaatcacttggctgggctgcgaccgcggagaagggccatgtttgattaggtgagttgtgttgcgcaacacacgctcataggaactgagttgcgcacgatcagggtaagatacatacatttttt

SEQ ID NO: 735 - DNA, 780 bp, Unknown
  derived from dsRNAs of unknown virus
gaatattgttgtccatagatttggttcgcagacacatatgcaaggaaacctctcaccgaactccatgccctggcatgctaacgtagcccgaccgaacagcgcgtgtaccatcgggtattccacgccaaagttcacgtcagggttgtcagcacatgccatcgctgagtggttcgactatctaacagccattgcggagaaacgaggcccaacgtcaaaggcggtcaaggatgcgcgtgcgctaattgagcctttcaactttctgcatgctcgaatggtactcaggtgccatttcgttaatacagatcagaacggatgcgaaacagtagacagtcgcgcattccgtgaacaaaaacaagctttatttgacaagaagcttgacttgttcctctcgaatcccatcatcataatgtccgccgatgtcacagccctactacagaagtttaggtttgtacatccaggtgtgccagatggtacgagaatcactgtagtcagctactaggtttaagtggagatatcatatgaaatgggtgaggtgttccaattcggcagccacattattacttggccggagattcactctcgttaactcgagccgaacgtgttctcattaagtcctaccccgccgggaacttaaacagtgtaactagcacgctcattaggtagcggctttggcagttatgctgtaccatccattctacgatcattccgaaacaaatcctatgactctgcctccctcattctagctgggggttgcgaatctatgactacatgaaaaacatc

SEQ ID NO: 736 - DNA, 751 bp, Unknown
  derived from dsRNAs of unknown virus
gaagaagagaggctgaatcaggacgtacagcatgacatctgattttctccgtaaacagttccgtctgggcagtgaatgcatgaaattacaaacgataagtggtacacctgtgtcaatatggatggatgttggacgtaacattctcccggatgataatgaatgtgttattaacgttatacgtgaggatcatctgtggggtgacgatttatacgttgctcccccctgtaataataacatcatatcccctgggaatccgaaatccttcactgtgatcctaacacgaaatgttgcttactcacttcgtcgttattgttttaaacgccagtctgaaaactttgatctcaacaattatactgtcgtatggccttcgctgcatgaatatctcacttatgaacataaatgttggaggtcacaattagttaggtcggtacaaaacctaaccagtgacaatacttcacttttcttcttactaccacctgagatcgtcgaatatattctttggtttgtgacacatgggccgtttgaacctttggacttcaggttcatgacgtgcttgcaaactcataacaagaagcaaaactggtggcgctggacaccagttcatgtgactgatgcactcgtaaatgatgtggatgcagagtatttttctgagtcacgtccatggctccataacgcataaattcatgatggccatgcaagtatgttgctaactccaacatatgtaattcctgattcgtctcttctaaaactc

SEQ ID NO: 737 - DNA, 4674 bp, Unknown
  derived from dsRNAs of unknown virus
gtagccattttggctcaaggtgcactgtgtcgctgagagatttcaatttggtcggtaacccacgccgatacgttgttacgtactataaacttttgggcagcacgatgacgaagacgcgttttgggaacacctgtcctaaaatctgtgcgtattgccatcgtgctgagctggagttcttgagcattccacgatgcgctgaggaccacatgatacgtatcatgacggtcgaccgctactgcctccgatgcaacaattcgtgcttcaggtcgaagtacgagaaggaggacaaggcagtagctttgcccacgagttatatcgctgatgcgacgagctttgccatgaagtatgaggcaagcacggcattcggcattaaaccttcgtgtgcagaactccagctggtgaacttggcatgtgcggcgcgggatggcttccgccgccgcgcttatttgacggtcggttacgcagcaatcatcgatgagcttgttttcaggggtccctcatggctatggagatcggtcactaccatcccacgcctggagttcttgaaacagttctatggttgtcccacggcttgggaagcactggatgctttaccaggaggaggacgtccaccacgaacgccgctaccattaccaccgccagccgagccacccagcgatgatgaggacgatgaccaagaggaaggagctgagaatggtcaaaacaatgtccaggcaccaggtgggaacgctgtgattccccctgggcctacaggcccaaggcctaatgtcgtctggtgtatacaccggggcatatgggttctagaagagcccaccgctgctgcggcactcgcacaggcagcggtcgctactaccgtggaagagcaacaacgggcttacgtggatgacgaagtgttgcacagcaccaccacggtgacgcagggtgaacgtccagagttggttgaaccgccggggttggaaggcggcgctgcaagtggagctagaactgcgagggcgcggttcccacagatcacaggaaaatccaactacctgcactcgaacaatcccaagaatctccaaaccgcacatgatatgaggaacattggtattggagttcacaacccactcgtgtcagaggccaggacacgagaccttcttcttgagcagttgaaagagaaggtctttacagacagtgctcataggaaagccttgcgtgacttcgagagcgtgcgtaaatcagccttacccaagaaactctcacatgatgagaggatgcgggcagagatggaggcgatgaacgcggcttttcgtgaggacggcgtagggtttgacactgttgtgaaagcatttgtcaagagcgaagtaacggctaaggacaagccaagggcaatcgcgaatcatgagaacacacgtttgtacgcgttggctaaggtcgcctacgtgttcgaacacgtcatgttcgatgtatttcgcggcgcctctatcaaaggccgcgccaagcgcgaagcaatcgagggcatcttcaagggcatgagtgacatgcgtgatggtgctagattcgtcgagaatgacttgacggcctttgaatttggcatctcggagcccctcaagcagatcgaacaagagatcttcaggcacatcgcgcgatcagtcggcgtggaagaaagcggtgacgtgttgtttgatcgagtcgtagaggaccgagataaatgtgcgacgtggcggatgacataccgcgacagcaccggtgaaaggaggactgcgaagataagaattccgcagaccatgcgcgagagcggtgaccgcgtcaccagctcagggaacttcctacaaaacttgatagcatggttttccttccttgttgacccggaacatgtcgaggatgcacttgacgcgttaatacgttttcgcggtgcgaaaatgttttacgtgtcgccgcgagatacgaccttgcacgaggtgaaaggtcgtatggtacgcaggaaatacttggcctgcttcgcattcgaaggagacgacaccgccggtcgtttcgaggagaggatttgggcagagggtgatgaaccatgcccgactcatgctttctttaaaaggtggggatgggagccgaagctcgtgtggaagcccatgaccggggacacctacatgcgcttcgtcggctacgaggctctcattgaagataatcatgttgtctacgatggcggcgagatggtgatgacgccggaagtacgaaggctggtgaacacaaagtcgtggtcgacgactgatgttacgccgcgtgaattaaagacatgcattcgcatatacgcttcgaccctagccgagggtttcaaacgcgttgagcctatgcattcttttctacaggccgtctacgatgacaacaaaggaggcattgatgtaaaagctgagaaggtgcgcgagtactacctggcaatgacgggagagttgccagaggccggcaccgtgatgactcgctcagtacaaatgcccgagttcgagggagcagaccctgacaagtggaagaggttgctccgcgtcagtgcgggcgatttcactgacagggaatgggcagatatgtgtcatatcggtaccattagaatgcacggtgctgacttgcgcacttgcgtccccgccagttggcgggattagcgtttcaattttcacagcgaggcacaagtccttgcttagtttcaccctcacacgctggtgaggtcggaagttgtgaatcagacgtgactttcgcttgcgattgagaattacctggctgcttgacacagggcgccagggtcgtacactaatcatcagattttcacgggtctggtgagctataaggagtgctgccggtgtacgatgtgttggtctggaccgcgatgatccatgcggccagtagggaacgcggggcatggttgaacctagcaacatgccttggccgggactgttcccaattccacccttatgcctgagtagccggggccagtccggtgaacagcctggggtcgtcgggagacgatgacggtgagggcactaccgttacccgcctgcagcggttactgttttcgagcagcagtataaaatggtagtttttgtacgtgagagtcccgaagcgttgcggtctgcgagtgcagggtgagccttacctgcacccatgtggatgcgcaacgtggatgtctcgtccgactcgcacggtcgggtgagtaatagcaaggtgtatataacaatgcgtggcgtacaaaacaattggcatcaggcgcggcggcgcgcctcttctgcagtttttggggacagcccccctatttatgacttccgtttagcgatcctgcgttcggcgcaactggcaaggccggtcggtttcccgtcgtaggtggtttgcacagtattatttttccgagcctggagggctccaatatttcaaaacacagcgaggtttgctcaaggtgaactgtgtccgctcgctgacatttccagctattccatttgtcactttggctctggacgaattgttgcgtcatgccgaataagaaggtgattaagcctatggcgaagaaccagaagaagctcaagaaattggtccgccgcaagtacgggtccaaagcagtcaacaggtccaacggtgaccgtgtgttggctcagggaacaggccatgtggcaatgcgcccatttggaggtggttacggcatcccaagatcgccgtcgctccaccccaagtgctgggatgcgttcgccacagctcacgcagcgttgcctcgttccgtcggtccatatacagttgtccgcacctcgttccttacacagacgtctgcacgttgtggcttcataggaacgtttaagcgaacggaacccacgcgctacaacgggtggtctaattgcgtcatggtcactgaggaggccgacaccgtgattagcaacacgcctgctactgggttccattacgcgccattccctggtggggcatctgacgctgatggccggaccctgactactttcacgtgttgccctgccgcgatatccgtgcagatgatcggccctgaggcattgcaggctgctgccggtcagctggcggcggccgtggtgccagcacgcatggatctcattaacgacacgcgcacgtgggaggagatacaaaccgacatcacctctttcttccgcccccgcttgatgtctgcgggaaaactgacgcttcgtggcgttcagatggactcgttccctctgagcatggccgacgtcagttcattcgagccccttatcacagaccccccgaaccccaacaatccgaggaagtcgccctgggacgccaaccagccatcccctcgtgggtgggcgccgatggcgtttgtgaacccctccggggccacgctccagctgcttatcgcggtcgagtggcgcgtacggttcgatattggcaaccctgcggttgcttcccattcgcaccacggcgtcacctctgaccagagttgggaccagcaaattcggcgcgcagcagacgccctgcctggcgtgctcgacatcgtggagaaggtggcaaacaccggcattggcttgtacaggggtgcaaccgctgccggcctactttgatgcagcaacttggtccgtcctcgccacgtgacaacgtgcgccgggatggcaggaaataataaaatcccacactggaggcaaacaggtggggcaccgctggtgtaagtagattccgggcagtctc

SEQ ID NO: 738 - DNA, 2973 bp, Unknown
  derived from dsRNAs of unknown virus
gtaaattttcctctcggaaactcctttcccctcctcaagggtcgttacaacgaaaggcacaaactaaaacaatcatttatgaaagataactctgacaacatcagtaatcttagtaaattgggtttctctactgatgaaattcaattactaacggatgctgaaaacaacaaacttgatgattccaaagccgaagagttgcatgcagcacttcgcaaaatacacaatattttaggaacattaacgatcaaacataatgaagaaatcgagaaatcaagcggcaagctaggtttcatcccaggtgttaatccaatcactaagttcgcaactagtgtagcggctgacgcacttggactagccggtaactcaccaattgaactgatggacgagggcatggctgccttaggtcgagcaggttcatcggcaattaacgctaaggaatcatacatcaagaatacagtacgtatttaacataaccattatggattattttgatgcattgaaaattccgcgagatttgctaaacacagcaaaccgaacaatgacctcatcgttcgtaccatcgcaatactcatcgaacatggatcccgtggcgcacatcatgaataaggaacactcgagcgtaaagcgcgtgaacacaaaagatgtaagcgccatggcggtgaaaatgggatggtcacttgctcaagcgtactcatacattgaagcatgctgtcaagtcccagagcacgttaactccacgtcagctacctttttcactaatgcgtatcacgcgagcgccactgatccactcaattcaagtgtgaacactgaaaatactctatggttcgtgaatgcgtggggcattgctgataatggtattagaccagaagtgaccagttggaaaaagtgggcgtcagtagcgcaaaagccagccgtactttggacaaaggacaaagttacagtggacccttttagcgctgcgtacgacaaatatgtaccccgaatggccgtgatatggcaaagcaggtgatatataacgaacttagcacggttaatgatctaactgacttagtactacaattcatcagggacaacgatgacagggagaaccatgtatggatacagggtactttcgttgatgctagaactaaaacgaaatatggaccaggtgccgtagtcgacatgctgaaagatgcagtggaggaatcgaatggtgtagcaatgcataattcactaaacgcgcctgccgaacatgatttatactggcgtacacccctagaaaaatccaaatccatggcgggcgagtatgttggtaaaaatccgtcacgtgttccagtgattccttggagggtaagtaacatcggtttacggatatatcatccaaaactgaaaccacaattgttccctgcaactagtctaatcactcgcaacatcattgaagataaattcatacttgatggtgcgatatattcgaactacagcaactatgtcaagctagtgcccattgaagccgatgatgatttagactattgctacaaagttgtgggacccaatcaataccagatggcttactatccagaatcgaagaagcgtggccgtatgtccagttacccagagaatgttcccgaaagcaaacgtaagaagaaccatcaccggaaacctaaaactgcagcgccatcatatctgcttgggggcaatcgcggcccatacaacgtaagggaaaagattaattttatggaacaggacccagaaatgcgttactatgtggatggcgcctcaccggagatgtttcctggtcataccttacccagtggtcatagcgtacacgccatgagtggcccaaaggcaaagacttatgacgcattttcacatgaacgtgtagcgattgaatcactcatggatactgtaaccaacaccgagtatgcggttgtgcgtaacgatgacacgcgaacggcaggtgatggtaccgtcggagagcactttatcacagcgctcaaaggtaccgctgaagatttgttagaaaagcatgaattggaaaagatgatagacggtgacgaaatcgttgattggccagaggccaacttcttctgggatgagcgcgaatatgaacggcgtaacaccgcaagcattaaaaggttaacggacaacactccctacttcccgtttcatgacagggatggaatgttgcagagccactttgacgcgctaaaaacatacatgcaagacaatccaacccatgcaatagtaatgaacgtaggtaatgatttcctagacaaaacgttccacaacggagagaaagggattgacataatatcaggtgtcattgtatcatcacgaattagcgaaaatatggcaagcagagttgccgaaaagaacagcatgcagcctgtgaacgcgtcccaatcaatagattcgcaaaatgagtacattaggcaagcaattgatgtgccagtgctactaatgcgtgaaattgacaccccaggactctatgtcggtgcaagtggcataggaaaatcaacgttcgtcaaagcctataactatgacaacatattcaccagtcacctatacaaggtagaggatccatccttcttttctggtcttggctctgtagtcaccggttcgcaccaattcttcggaattggtagacgaccaggtgaactactacaacagcgtagaagagcggagcaaggaagaggtgaaacgtcaggccatatgatagcttcagttctagcacacaaaagtcatttcctacactacctgcaagaagtttatacaaatttcataacggaaaaatcaatctaccacttcccatttaaagagcctaaagggaaagtgtatcatccaacatcggattatgttaatgctgtcacagacatgcgtgcactcgacaagatagggcgatatccaaattatgccaaagataatatagatatgtgcgctaaattggttagtaacatgagataaactgtaaagggaattcagatgtaaaacatc

SEQ ID NO: 739 - DNA, 6560 bp, Unknown
  derived from dsRNAs of unknown virus
gggaaaaactgggtatgaagaacataccactccaaagggaagaaaaacctatcctccagattggtgaagtaaacaattggcttaataaaagtaagataggaagaaataagacggatcagatgatagtaagtggaaggatagggataactatagatataatgaaggatatctatagcatcgatattataaaccagctaagtatgggtgaaagtctaatagaactacagcaagatgtttcagaagcattcagtagtatgctaagtttagcaatggcagaagaaagaatatcacaaagactacaaccgaaagcagaattaacaataaaggagattaatgtacaagatgaagctgttagcaatgatggcaatatagaacagccaagcttagcatcgacagtaattataacagatgaaaatatgatacctaaatatgtattaagaatatgtaccgatttccagaaagcatataatacagtaggagatatcatgttacttaattctgaaagtgaaataatactctacgacataactaaagcagtagaactaacagcaagtaaagcaatattggaattgaagaagttagcagaaaaggagacaattataaaagaagagaggaataacaatgaactagcaatggatgtattggagttaatggcaatagtactgtacttactcaaaaatacaaagcatgatttattacgaaaagaaggaatagaaatgtggaataccataagggaggtaatgacatatgcctaataaaatagaattacctgtaaacaaagtaattgatgaagttacaaagtacccagagttaataagagtaataaagaagaataagaaattactaaatggtaataaagaagggctagaaatggtagcaataccaaagaaaatcgatagaaatactataattgataatgagatgatggaaatgcttagagaggctggagtaataaaggaagagggtaaagattatatagtggtggatacaagagtattagataaaagtacagaggctggacaggcatttacaaagaaaatagctgataagtttggaatagatatagaaaagttacaaaagcaaatggatacattgatggcattactcgaaggtgattaaagatgcgagaagtagtagaaatagatggattagtatctcaacagagaactataacggacaaacaaaataagatacgactaatgtatgacataccaaaaagacgagtgtttgaaagtcttgatgtaacagcaagtttagtaataggagtaagaaatcatgaatattatagagaagaactattgaaggatatatatagacaagtatatctaaatatgattcaaatggataaagacaaggaatatatggatatgctgtcgagtctcatatatacaataagatcaatgaagacatatttggcgttaattcctggattagtagtacaggagaaggaacggacagtaaatggaattaggtatgaatttgtaccatatacactacttaaagtttatgaaagagatgtgggaatgactaatattgatcttgctatactgcaagtaggtatatggcttgcgccacgtgtaaggcaactaaggcatatgataataaacaagctattatcaactgtaaggtcatcagatagtgcagcaagaagtattcagttattaaatgcctggatcagtaagatgacggaaaagctacaagaggaaaagaagaaaataacagatataattcagcaagttcactatgaacgtgcaataaatatattattaagaaccgaagcaatactgacagcaatgctactttaccttcatgcatggatagaagttggatggttagtatataagaatcagaataatctagtattccaaagaccagaagatgaacaaagagaaaaggataactataagaatgaaagattaagtgaaatagcaaaaggaatgacagaattaaggaatattgaggaaccactactagaatatgcaatatatagattatttagtaaaccattagaggcaggtagtaatgacaaagaaaatgatctgctatgtcctgctgcagttgaattaacgtatgaaaggaatagggcaagcttagatgtgaggctatttgtacaggaacatcaattgatagaacggatgaaagagatccttcgagtagtaacacctaatctcgtatcaagtgttcaggcaatcagtgcggagatggacaatgtaatatcagcaggaattgaaacaagtgtgtatagaccaatgagagatgaagtattagcatcttgtgtattgaagagctattataatggtatatataaagatttagacaatctaattaagatgctagagaaaggtttgggaacaagggacgactggaacatgtatcaggcacttgtgacaaggaatagaaagtatcttccgatgcattatctattaaatagtctattatttgcaatagtattggaaagcgaggtcataacatatacagctgatgtaaaagttgaaaggttggatgacatgattatagatatgacagaagttgaagtaatgaacttaatatcaaatgttatggaattaattaatactgtaaatagtatgaagagccagatagcaataaagagaggagcagtaaaaacaaatgtacagtttagcacatatgatcctaaatttccaatgatatcaggaaaccaaccatttataatgtatattcctacggtatttacagatcatagagacctactgccacagccactacagctatcaattggatcaccagcaataacgggttattcaataaggcaggcatcaggaataaggattccaggccacgaaatacaagctcacattctactagcaaaaagtagagtttcagacattaatcttattgaagataaggcaaaaataatagaaattccgggacagattgagaatgacagtatagtaataacggaggtatctggctatacagtaaaaagattaaaattgaagactctagcgggagtaagcggaaagacgaaatacggactagatgtaatagaaagaataaatgatggtcttatgactacagcatatcttcgttcaaagaatgtagataagtatatagctgaattagttaacgtaactgaagaatatcacaaactgttatataagataggaagattagcagcaacatattcaagtggtaacgagtgtgaaataatagatgataagacgattaaatgtgatgtacgtgccttaggatcaatactatttgaaccaataatggcgagaggtgactatgaaggtgtattattaaacatgaacggttacttaggccagctatggttggcattaatggttaccaaagatttagtagaaactaaaacaggtgggttaatacaagttagagatataatggattcactaaagccggttggtaaaaataaatggagggtaatgacagtattatacaataatggaaaactcgtatcggtaggctttattgaagataggtctacaagttatctagatgagaataatctattctatagactagtagagaatataagtgcaacagcaattaaaaatgaaaagattaatggaatagatcagaagtatataatacttagagaggatgaaaggataacacaagatgatatgtataaattaatattacatacagatacaagtcaaatgattgatgcattaagacagttaggacaaaagattgcacaatatggaatctctgtttctagagaagttttaggagagattacaaatatagcaaatatgataaatacaaagttgccaaaaccactagactttatatcgatggggacaggattaatgacgttatatgaacaaatatataatacatataattataagataatattagcatctgatagggtaacgacagacagtatgacaaaagaaatattcataagagttttagagataactgacagttttgcaagcctgaatggacgtgtaataaagacaataccaagactgattaatgatctattccatgcaactagggtaatttcaaatacaatggtaaacggtaaagaaagaatgctaattatgggtgacgatataattcacaatagcatgcatatatcacaaatagtaaactacttagataatgtaagtataagccaattggatagaccattatcatatgatccagtaccgtttacaatgacaatgtggaaagaaccgttaaacatggcaatatcttcagaggaagttaacagtagtagaagcatgacaaaaggaattgatcctagcacaacacaaagtaattcaggactaggtccaggaatggaagtaggtgcagctagaaagaatgatacttcagtgaatattgttaataatgtggaagcaaagaatattgcggctagcacatctactagctcagctgaaagtaaagctaaatcagaagggtctggcaatccattaggagagattggtgcggcagcagcactgggtggttgaaatttttgaagaactattttctcaatcatatccagttaacacattaataaatggaaaatacatgattgtaagtataataccaaaaagtctggacgaagcattaagggaatatatagaatatgtcggaagaaaatatggaaagagaactccagttgtagattgtgagccagttacaggatatacaaaatatgcccattcaaaaggcaatgtaataggagcaggattggaaagtagagtagaatccagagttgagggagaatttattgaagacattaaagattggctagcatttttggaaaataatagtgtacctgcagaagtagagacatttagcgcaagtggaggatgtttcataaataatatcattaataaaaagtatttaaagttagtaaataattacagtatagtaaaatctgtaattatagatctaaataacaagatcttgcaacagaaagaaagagtagcagaattactagaggcgtttaaaagatacttatataccatgtataatgaggtttataatgcagttgaaaatgacaacagaaaagcaatattttatgggacaaagcgtgaagaagctggtacaggcatacgatcaatatctggaactacattaggatcactagtaggtagtgctagtaaagaagaattggaaaaatatatatatgattcagctttattaatggcagttgcagttgatgctatgaagaagtggctagaaggaggggatgcaggtatagtaaacacaatacacattgtcagtaatatatatagtggagtatatggcgttagaagtgatgtggaccgagacaacataatacacaatggaatgaaggagtcatatagaactgaaacattgacaagagagataaatgttgtcagtccatcatcagcatttgcgaatggtaatatatctgaaaatgtgaaggaaagaaggagagaagtatacagaacactatcaaaaatggtaaacgcaatgttatatccaccagatataatgccagtaactgaaatagtaaaaataaaagcagtatatccacgatattgggtatttaatgggacactaatatcaatggatcttggaggaagcagagaaggtgtcagtttaggtgcagatataacattctttcatgcaatatcatttgtatatgaagacttatatggtagcaggacagcagtatacataggaaatccatcagggtttccattaacacagatgttgtatactatatataatctagcaatatatgcaaactactgtataacaagtggtctgatattgggcgatgatgctcatattaatttctgcagtaataaggaagcagagagatggtacaacgaaaatagagactttgtaaagataaagggaatatatattgatgaggcagcaaaaagagtaattacacacatattaggaacaatgtatgatatgaaagaaggacgtgaaccaatagcatataagattccaaagctaatcaaaagtgaaacaacaccaaaggaaagcactggaatgatatcaacctggaaaagaaatgtaggtactacatttaatattgaacaggtgaataatgaacagacagtgaaggcatttaaggagcaatatccaatgataaggatagtattttatagcagaaatttagatgaaataaaattagttgaaagcaatccaagtttgtatgctgaagcatacaaggtaacaaacagtacaggtgacttaatagcatcaatgaggtcgactagcaatgattgatagattattaaagctaagggcaacactacacatgatagtaatagtggccatattgttggtaattatatacggcgcaactgatatgctaagagctgcaataataggagtattattagccagtagtattattgacagcaaattgtatctacgatacaaagatataatgccacactcactacagttaatactgatattaggaatggttagtgaaggaatgattgcatttgtatatatggtcaacatattaggaattggaggataggtgttaagatacctggtttttcccctccaaccacctgagggccgggggtggagtagtaagaggcctaaacctctctccc

SEQ ID NO: 740 - DNA, 6117 bp, Unknown
  derived from dsRNAs of unknown virus
gggaaaggccggtacagtaattccaatgaatacgcccgaggccggtgggtagccgccggtccactctgggtagccagggtggtagggcaagtgattacagtaaactaatagtccggcctagatccccccgcggctttaggcagtactctagcagggtgggaagggcatccgatgctggtgggtagccgccagtccatcctgggtagccaggatggtaggatgtccaatgactaggtactgcctatacgcgggttaacgaggggatccgggccaggtgaccacccaccgggtccccacaataaagtcaaatgagtcagagagtccaaagaaagtacaagtatacgcgggggggcccggtgaggtggttggatatggtgtcttcggggctaaataaccaaaactcaaaagtccaagagaaagttgtttttcttacaaagggcagtatactaaacacgatcgaaataatcagtcgacatccaatccgaccaggatactatcgaggagcatacatcaaggacactaacgggcagatactagcaaagttaaatggagttactatagaacaagttccagggagcaagagatatataatggcgtatacgatgatattacagaatggacaggtagataatatcagtgttatatgcccactcagagtagtagaaataattagtgaaaacgagctagaatttgaggtgaaccagtatgcttaaaccaaccaagatcagagaaataaagctaccgattgacaacataatctctgaggtattagcaaggcctgacattgtaaagatgttaaagtacaatggtagacttataagacaaggacggctaaatcagctagtattaccacgcaaggttgagaacgtagaattacttccagaagattatcaagaactactagcctcactcggtgtaattgaagggaaggatcaggatgtactatgggtaaatctagaaaagttaaatgagcttagaaatgacagcgaaggaagccgtaaattaatcgaaaatatagcagaaaagtatgggatagatgtaaggaagctgctgaatcaagtagaaagtatcaaaacaataataggagagtgagagcatgcacatatatggtactataagcattggaggtcttcaaggaagacaaagaactcttaaaggaacgaacatcaatatcatcttcaatgagccttcgaagttagagtatattctaaagtggaaggcgaagagtgtagcattgagtcattataaagaattattcaacatagacaaaatagaggaacagttatacacagaagtagagagatcaagtcatatgatgacaagggaagggttcaaagcaagtattcagagctatgtgttccagttacatgcaaataaacaatatttactgcttgcaccaacgacattaacatatacagatacagatggtgttcctaatgtacgtgtagctgataccatcttactagaaggttcagctcttccattaacacaatatgagagaggagtattatatggattagcatggctatatgcagaagtctgggatagactgtcaactctcttccatgagttgttagcagcagcaagatatggaaggcaaccattaagtacgttactaacaacattacaatcagaattgcagagtcaatatatccatgaaagtaagattgaagagaaggttaagatcttatacagagtagcaataattaactacctgaataaggaactaggagacatgctagaatcactgaatcaagtatctacaaaactatctaatttggcggaattgcaaactcaatggactaaactgctaagtgagataagaaataagttaagtgaagtagcaagaaaggcaatgttgtatggtaaaattggtggaagtggagatagtgactggtactatgcaggagtagttagagatttcatagatacgacagggataagagtagaagttatggatgtcaactcttataaacagagtgatgcacagagtcgtattaaattcatactagggccatcgactgagagcatctacgggagtctattgagttatgcgattacaagtagtgataacgagaaacttaaggaattcatatcagatgagaatataaggaaacagctagtgaatatattacggaaagtatttagtatactagggactctaacgttaacaagtagagactgcaatacaaccatttcattaatgatagaagcattacccaatcatagagttgaagttggtcttgaagcagctgctaaggtagtcatggcgttgattgatgtagcaaacttaattagtgagctagcaaggctgccgaataatatacgaccagttgtcaatgggaatgctatctatacgaacctaatgccagaacggataattacaaagagtgatgtaatacaagtgacttatccattaataatgacattacacgcagagcatggactacgtgcaacctatagtgtaccagggctattaggcatgagccaacgcggggagctagaagcagttatcagtactgagactatattgattacaaatagggaaatcacaagtccaagtgagttagtgcttccagttgaagttcatgaggttccaggtatgatcactgaaatttcaataaggagtatggaaattatgccaggaatcccagattatctacgggagtataaggtatacttaccaaagacatttagtgaagagctacaacgtatcagagtctatctaacacaaatcttcgaaaattatagacatcaagtcgatgtgcgtgctctgagcgacttgctaaacacttacttggatctggcaagaataataatacgcaggttggaaacaaataataatggtgaaatagatgggcaagcattaatgagtagtctactactaggagtagcaattccaacacagggagtacctggcataagatatgtctataagagcgacaaaatcctaggtattctaacactgaatcttattgccaaacgttatagagctacaatagcacaaaatctaacaattcataacatgaatccagagacggatacaattaagatcgctgagtacaacgaaaaccatggtaaaattatgttgagagctgaggcatatacacttaaagatgttaaggaaagaagcaacttagacaatgaatacataaatcatgttccaatattaccgaacggaccaaggtctgtgtacttggaggctattgctgctgatactaaccctgaggaagttagacaacttattgaagaaattcacatgaacattgagggtgtagtaaacgatatagtaaggagatcacaatttaaagtggagtatcctactacggacctaggaatgttaataataccagttgagcagtcaataaacactacattacaatcgctacggagtgcaagtaggtatcatgcagcaatatcaagtatcgtaaatgactatctcaacgttatcgatagatccggagatataacagtgacaaatgatatagaaactacaaagatactgggactgtataccaatggttcaggaggaggcatccacgatcagttggtgatgaggttagcaccagctttcagatatgcaataggtactgcaaggaagatcgacaatttgacaatcaacttacctatagcaaaagactgtgcaggaatattagttgacagaaatggtatggacttaagtagagtccaatacatcgttacaccagtaaatccaatgcgcataccagtaccaaagagtataatagatcaggtccagttcccagcgggtatatgcctagtagttgatgcggcacataatataactaaaccggaagagatcaaggagtactatcaacgtattactacagtaggaggaggtcagacagatacaaatatgggccaagagaaagcatctactacaaaatcagaaaaggaatcaacaacgcaaccaacgcagcaaaaccaaagtgaatcatcaaatagttcaaattctacaactagtaatcagcagtagccaatacagtgattagaatgagtgcaaacagtgcagatgtgataaatatcaaagagagcgaagtatatcgaggacattatctttcactattcattaagcgatacgacttgtatgagttccataatatgtatatacaattaatgcggaagaaatacggagggcgaaagccagaaatttcctgtgaaccattgacagtatatacacaacgtgcgcagacaaacgggcatctagaaggggcaggattagatacagtaattaagggaagatcatatgctgaatttctccctctagttaccaatgaatggatacaaccaatgctgagactagcaaacgatgtacaagaagaagagttattagcaatggggtccgttggtggttgctttcatgatataccaaataagaaagtagggaagctggtacagtatcagcatgagattgaatcaatacaagtagaatttaatacactattattcagtaagactgataagcttaagcaattgttaatgggattatatcaatatacatttacaatatatcaggaagcattgaatgcaatacggcaggacaaacgtgagacacttctatatggaacaaagagaccagaagctggaacaggaattaggataggtggttatagtactttgggtgatctgctacaatacggtgataaggagacgctattacgattcattgatgatgcccaagcagtagcactcgcagaactacgggcattcgagttatttctacaagcacgtgatcccacaaaagcatacgtggttgaaataatttccgatgcatatagaggcagctacggtgttagaagtgatatagatagatcaggaactcatattgaagataatagacaatattatggatacgaatcaaaaactagagaagtaaatgtacttactccagccagtgcatttagcaatgctaatattaatgagaacactaaaaatgcaagacgatatgtatatcggttagtttcagaactacttcacattgaattgatgccaccagacatcatcagtacacaaaattatatacggttggttacagctacacaacgatatgaaactgcagataatatgggaccggtattagtgagccgagatttaggatttacattagaaaatggcagtacaacaccagcagatttggtgtacccgagtagtatcggtattatctataacgatagtagtatggtaccgagagcaatatttgtcggaaatccatcaggggcaccaactacccagattatctacttaggttataatatcgctatctatgatggttacaatatagaatatgggatggtactaggcgacgacgctcatgtcatcttcagaacaagagccgatgcggaacgctgggacaaggacttaggatacctatatacaaagactaagggtatattaaccaatgattctgggacttgcgaatacacatttattctaggaacagtttataagtattgcagagatggaagtgttgctggcttcaaaataccaaaggatatgaaaagtgaaactacaccaaagggcggtagtactgaaacaggatgggtatttaatctggaacccacatttcaaattactagagaaacaccagtagaaaagattagggaattcacaagtcaatggcaactgataaaaatcgtatttctgcaacgcaacaagcaggaagtggagatagcattaaccgatccaacattatatcagaaagcctatcaagttacggggtcaacaggagatctactactaggggaaagaggtgcaagtaacctgtgagtctcataaaacacgcatctatcagtagtaaccttcaatttctagcattactagcattactcttcctaccaagatacactacgattacgataattgcattaattggagtgtatataactactatatatagcatggtgacatttatactactgacaagacatttactcaggatttccactatatatagtataagtaccatattaaaggtgctagctgatatactgatattagtatatctacttagacaagtaatgatctagcatagccccgaaggccgggtaggggtaaaagggcggcccctaccttgtaagttatgccctttgttttcgaccc

SEQ ID NO: 741 - DNA, 6013 bp, Unknown
  derived from dsRNAs of unknown virus
gggaaaagacatggagtcggtacggccccagtaccggcatgtgtagtcaatccccttcctcgtggctacggccaccatggggtctccggacctcatgggaagggggatgagatgaaacatgctgggaatgggcaaccgtacggcggactccatgctttcccgggcagctggccaatgaatactactgttaaccagggagtacagtgtcccagctgcctgaaaccccgcccggctacggccggctgggtgtcgggaagcacccagggggttgaaaatataagtagagtaggggtcagttcagtgaaaccccactggcccctatagcatacagtgctttcagtgacaaacatcagggcggggggccagcgaggtggaaatatgaattcgggtgtaggtataaacccaaaatttcaaggtaaggcagtcggtgtttttcttgaagaagaagaagaatggatcgtactacgcggtaagctagcagagacactagaggggagatataacgtggtctatctgaaggctgccaacaacggcgcagtaattggacgactcacagatgtgaacattattaagggccagcagataactggtgcgttgatgcagtataggacaggggcaataagatcggattatatcaatgtgggagagttccaagtagtacgtgttgtaagaataccagagacaaatgaacttgaggtggtggtaaaatgaaacagaagaatacaaggatggtacaagtcaaactacctatacaagatattgccagtgaagcattgaaatatcctgaaataattaagacattgaaggcaaatctgaagaacaaagacttcaagaatggtattatcgttataccgaaacatatcggggaattacaggtagtaccagatgaatacatggaggtgttcaaggcagctagtataatagtaaaggacgacgaagatgtattacatatagatttcgaccgactgcagaaagttaagcagtctgacactgaaattaagcagatactgacaaacgttgcagagaaatacgggttagatattactaccctactcaaacaagtagagagtataagagttatgctaggtctaggtgagtgaatatgcacatatatggaacactagatatacatggtttaacaccaagggtcagagaatttaagggcacaagtttagacataaggttccaaagaccaacaacaatgcaatatacgatacgatggaggagtaaggcgatcgcatacagtcatttcaacgaactgttcaatgttgttgggattgaagagcagttgtataaggatgttgagaaagcaagtaacatagccccaatttcagagttcagcaatataatacaaaattacatacggcgactacatgaagggaagaagtatatcatcatatctccaaatatactaacatactatgacgatgatggagttgctagggtatatgtcgcagacggccatatagttaacggacaatatattagtactacacagtatgaacgtggagtactactggcattgagctggcttcactatagtatctgggacaacatagctacattattacatgaaatcttagcgcttaaagggaaggatactagcactatagatatcctgttcactactatgcggaatcaagtggcaggcgaggcgacacatgctagtgacataaagactaagcaagagaaactatatataataagtgttatagactatatgcagcggaagctaaagacaataatcgacgagacaaagaatatacaactgactagtgacagtgcatggttagatacactatcaaggataaggactaaggtaggagaatacgccaggaaagcaatcaagaaagcaaacactaaccagacggatattgaatggtatagtaccaaaacagttagtgaatacatagacaccaatgggacacggataacacttgtaaatcttggtgattatgatcaaacagatttagataagtatgccttctacttagggccgagtctagaaagtatatatggtagtatcctgaatgctgcagtgaggaatgctgaaatacccaaggaactgaagtcatttacataccagctaatagacatgatagcaacactcacattaaatagccgtgactgtaatataagtatcaagacaactatagaagagatacctagcagaaagggcgaggaggtactagagagagttgcacagatactgaccatgataattgacatagcaaatactatagctagcattgctaggatggaaaatatgaggacagtagtatatacaaatgtagtgtacacgaatatacgtaaggacatgcggctgacaaaaggcatggtcggacatataatctatccattatcaatgactattaacggccgcgacaggtataagttagcatacagcctcccagcaatcatcggcttaacgaagcacggtacaatagagagtgtactaagtagcgaaataaatatggtgttgacaaaaccactaaactcagtccaggaaatagcggttccagtagagattcatgaaattcctggaataataagcatcgactcaagaggtacatctctaaccacctcaatgtctgaatttataagagaatacacagtcataactacagacggagtggagcagttactcataaaagcccgtgagacagtcgaaaatatctataaatcctacagaacaaggagcgacatcgataacttaataaatctagttaacacatacttacagtatgcaaggatagtagcagagcaagccgaggggagtggaccaggaaatgtacggattcaaggagaaacactggtaggtgcactagccttagggataatacaaaatgataggtatctggttgatagcgataaagttctaggagtcctaactctaaacgtcataaagcgtaggctggagaaagcagggatagtaaagcagataacgacatacaatagcaatgaaatggctccagtggcagtttataatgagaatgaggataaaatctacgtaaacagaacaagaattccaatagagaaaataaacataataaaggagcttaaagataatgtgccgaagctaccggaagtaactagggatgaactcctacaggtcctagtatacgacataacagaagaagaattaaatcaggtactaacacaattgaacatagacacaaacactatactcgataagatagtaaagaatgctaaattcataattgatacaaatgctggaccaagactaacattaaaattgctgccaattagacagcaacttacagagtacttaacccggatcagaagtggagagaattacacaatagcactcactagtatcacaaatgacttaatgagtgcagtagcattacaaggtgagatggaggtgaagggagtcgaacaattcaagatacgtgcattgtatacagatggcagagggagttcagcgggacagcagatgcgctacgatctacggattgcaccagtactagtctatactataggagctgcaaaacaactaaacaacatagcaataagggtaactatgactcagctggctggaattctattagacaaagacttagtagatcttggggaaatgtcatatcaggttgtatcaatagaaccaccatatgagacaatagtgaatagcttaattgataccaaacggttcccacaagctacgtgtatagtagtcacgtcaacaggtggaactatgaaaccaaatgagatcacggacttcagagcatctatggtcacagtcggacatacaaataaggtatcagcagagcctaacacacagaataaaccacaggaaaacaaccaaactaaaccgaatcaggaggctactgtagaaactaataacaacaacaataacaatggaactcaggcaactagcagctaagggggacatggatgaatatcgatgaaatactgcatctacaggagaaccacgtaatatcggggaggtttttatccttatttatatcaagatacgacatcacagaattccataatatgtatctggatctaatgcaacggaaatatgggggcaaaaagccaagtataagttgcgaacccctgacagtatatacagtaagaaacgtggttgcaggtgccctagcaggtaacggcttagagagtaggattcagggatggagttatgcagagtacgataaagacatcgtaagggagtggattagcccaatagaagagataacaaatgacgtttctaatgaaatatatagtatgggatctgtaggagggtgttttcacgacattccaaataagaaagcattaaaactgcagcaatatcaatatgaaatcgagcgcacaatgatagatttcaatcaactactgctacaaaatacagtacttctaatggatctactaaattcgcttatgtcatacacgctcacgatatatgcagaagcagaaaaggctataagttccggaaaccgtgaggcaatattatatggaacaaagagaccagaagctggaacaggcatccgtctcggtggatattcaacattaggggatctattacgctatgcggacgacaatacactccttaagatagttgaggatgcacgacttgtagcactagctgaactacaagcgataagactattcttaaataatggtgaccctacaaaagcttatgttgtagagatcatctcagaagactatcgtggatcctacgggatacggagtgacattgatagagaaaacgtacaactagtgaatgagaaatctaggtaccagtatgaaagcatgactcgagaggtaaatgtactaactccagcatctgcactaagtaatggtaatctcaatgaagtaacaaaacaggcaagaagacaggtatatactcacgcaagccaactattacacattccattgtacccacccgatctaatacctattgaacaatacgggaacttgctgacaactatccgaagatatgaactgggaccagaacaggggcaagtactagtgagcagagatctggggtttacattagaaactacaaccacaccggcagacttagtatacccagggatgttaggcatcatatatcgtgacagcagctttcaggctaagaccatcttcataggaaatcctagcggtgcaccaacaacacagatgatttacctgggatataatgccgtcttattcaaaggttatgccatagattacgcaatggtattgggagacgatgcacatatagtctttaatacatacagtgaggcagaacgatgggagaaggacttaggtcagacatatgcgaaaaggaagggtttaatgctaaatgataacggaaactgcgagtatacattcattcttggaacagtgtacaaatattgcacaaatgggactgtaatgggattcaagattcctaaggacatgaagagcgaaacaaccccaaaagggcaatcaagcgagacaggatgggcaatgggcttagagacaccattcgaactagagaggacaaccccagaaacgaagatacgtgagttcaaggaaaattggcaatacgtaaagttagtattccttcagcaaaataaagctgatatactaactgctataagtaatccatcattatatgcaaaggcatacgaagttaccggctcaacaggcgatctgattaatgcattgaggtgattatagacgctacgaacatacatacgactcaataatgtacaatttctaatgttgctattgttgatattccttaagggggaactgatacagctagcagtctggacgggcttaataatcataagcaccccattgttactaatgagtgtagaattactgagacgtacaagggccttaggaacagatataatatcaattatcatagtgaagataatcgcagacacaatcataatggttacagcacttggtcacctaatgcagtacatatttacctacacccgataacgcgatgatccctgccctgtgcccggggagggggatggcagaaaggtataggggcatttctttccatccc

SEQ ID NO: 742 - DNA, 6008 bp, Unknown
  derived from dsRNAs of unknown virus
gggaaatagcaggagtcggtgtagtcccggaaccaggctaccatattggatcccttcccacgtggctccggccaccatggggtctccggacctcatggggaagggcatgaagagtggtagtctggaaacgggctcctacacggcggactcctgcatttccccggtagccagttgcggaagctgctgactgttcagtatctacagtaacactggctaccgtaaaccaccccgcccgactccggtcggctgggcactccggtgcccaggaatcggggtggatggatataatactgagaatgggggtcaggcttatgacacccccctggcccctatgttatacaacgatttaaatccagcgacagaacatcagggcggggggcaggagggtggaaaagggtggaagaaatggtgtatccaaaaaccgatatctataaaggcaattttatttttgaagaagaagactggataatattccacggtaaaacagtcaaaagtctacaaggtcattacgacaaggtctatcttaagtcagcaacaaaggatagaatagtagcattgctaagagacgtaactattatacaagggaccgaacctaatactgcactagtacggtacagtacaggagcaatgagcagcgatatattaggtaagggcgaattcgaagtattgcgcaccatctatatacctggaacatcagaattggaggtggtggtaaagtgatgcaagcaaagaagccaatcgagattaaactgccagtacatgagatagcagcagaggcactgaaatacccggaagtaatagatactataaaggttaatttacaactaagacggcaagggaatatagtggcaattccaaaacatatcggtgatcatcaactacttccaatagaatatttcgatcttctaaaagagataggagtaatcgtaaacgaggacaaacacgtgttccaggtagatttccagaggttggaagagattcataaggatgaacagggaattcgtagactaatcgaacaagtagcagcacactatggaatagatgtaaagactctaatgaatcaactggagagcatacgactattacttggaataggtgagtaaagtgcatatatatggaactctagagataacaggtcttcagcctaaagtaagggaatataaaggaagcagcctagatattaagttccagagacccaccagtatacagtatacattaaggtggcggagcaaagcacttgcctacagtcattacaatgaactatttaacattgtaggaatagaagagcagttattcaaggatgtcgaaaaggcaagtaatgtatcaacccagcaggagttcagcactacattacataattatatacgaagacttcatgatggaaagcagtacatagtgatatcacctaatgtgttactttattataatgacgaaggtataccgcaggtacatgttagcgatggtcaattggtcgaaggtgcaaatattgaacttacacagtacgagagaggtatcctgctcgcactgagctggctacactacagtgtttggagaaacctagcttcactattgtatgaaatagttgcagcaacaaagtatgacagcagtgctatcgacatcttatttagtgccttacgtaatgaacttgtgagtgaaataccaaagaacaatactataactcataagcaggagatcatataccgtctagcagttcttgatcaagttcagaagaagatcaaacaagcaatagaggatgcaaaatctattggaagtattaatgaggagacatggctgaaaggccttgctaactttagagagaacatagctatagttgcaagaaaggcagtgactaaagccatcgtaggccaaaaggatcttgactggtatagtactagcactattgaagaatttgttgatgttaatggtgctaaagtgacgatagttaggcttggtgattatgagaccaaggattatgataaacttgcattctatctagggcctagcttagagacagtatatgcaagcatattaaatgctgcacttaagaatacaactctagacgcagcatataaagccatactcaccgatatagttaatattatagcaacacttacattaatatccagagactgcatcatcagtattaaagcaacgatcgaggagcaaccaacagcgaaaggggaagaggcactagaaaaggctgctcagttacttacattaattattgacactgcaaatattgttgggagtattgctaaggttgacaatactagaagtgttatatacacaaatgtagtatacacgaatattcataagaacatgaggctaactaagggtctgacaggacatattgtatatcctgtggctttcacagtatatgggagagatagagtcaaacttgcatatggagtacctgcagtcctagggttgacaaaacgcggaactattgagagcgttcttagcagcgatgtacatatgataaccactaaaccactaaatgctgtacaagaagtagctataccagtagagattcaagaagtacctggcgtcctcagtgtaaacgcccgtgggatatcattatcatcaataatgtccgaattcgtaaaggaatacaacatccaagtcgtaaaggggattaaggaactactcgcaaaggtacacactacagtagagaatatatataagaactaccggaatataaccgacatccacaacttacttgatctactaaatacttatctacagtacgctaagatcatcttagagatatctgaaggtagtgggcaaggagggtcaaaggtaaacggggaactattggtaggcgcattagtccaagggattatacaggatcagcaacaactggttgatagtgacaagatcttaggagtgttaataagtaacataattgccaacaggcttagaaaagcaaaggtaatcacatccataacatactatgataagtcagatttactaccagcagcagtatatgattcaaaggaagataggttgtacttaatacggtcaccgactccagtagagagactaaatctaccaaaggaactcaagaataatatcccagtactacctgagatagacagaggtgtctacaatcaaacattagtctatgacataacagaagaagagctaaggacggtattacaacaactaggaatggagctaaccacattaatggacaaggtaagccgctcaaaattcatattggagtcaagtttggtgtcaaagcttatactaaggctgctaccaattaaacagcaattcaatgagtatcttgatagaatcaggagaggacaaaattatacggtagcaatgagcagtgtcgcaaatgatttactagatgcaatggctatacaaggggaggttgaagcagagggaatagagtcatataaaatccaggtcctttatacagatggaaagggaagtgcggcaggtcagcagctacggtacgaactgagactggcacctcccctgatatatacaataggtgctgcacggcaagtatcaaccattcgtataaatacagcgctacatgatatcaagggactgttgctggataaggaaattatcgacttcagtgaagtaccctatcaagtagtaccacttacaccattattcaatagctatattgaatccattatagataagaaacggttcccaacagcaacgtgtatcactataatgtcatctactgggttattaaagccgagcgagataactgactataagctatcagtagtgacagtaggaaggtcagcggagacatcaaccactaaggaggtaacacagcaacagaacataagtaccaagaatgaacaatcaacaggacaacaggagaatacaaacagcaagaatggatcagcatcagagcaacaaggacaataacaggtgtataatcaatgcagattgatgcagtactccaattaaaggaaaaccaggttttagcaggacatttcctgtcaattgttataagcagatacgacttaacagaacttcacaatatgtatctagacttactaacaaggaaatatggtggccggaaacctagtatcagttgtgaaccactgactgtttacactctaaagaatgtggtgtctggtgttttagacggaagtggccttgaaacaatgatccatggctggagttatgcagaatatgatcctgatatctataaggaatggatcgccaaagttgagcaaatcgttacagatactgacaatacgatatggtcaatggggtcagtgggcggatgcttccatgatatacctaataagaaggcacttaagctcatgaaatatcagtatgacatcgaacggatgatcatcgatttcaataacctcattctacaacaacgtccaattatggaagaacttcttaatgcactaatatcatacacactaacaatttatagtgaagcagagcacgctattaggacagggaatcgtgaagcacttctatatggaacaaaacgtgcagaggcggggactggtataaggataggcggatataatacactcggaagtttactacaatatgcagatgatcaaacactactaaagttcttagatgatgcaagattagtagcattaggagaattacaagcaattagactgttcttagaggctggagaccccactaaggcatatacactagaaatcatatcagaagactaccgcggttcgtatggtatcaggagcgacatagatcgtgaagatgttcgtatgactgaaaacagatcacagtataactacgaatctatgacacgtgaggttaatgttttaacaccagcatcagccttaagtaatggcaatttaagtgagcggacaaaggaagcacgacggatggtctaccaaactgccagtcgtttattaggcatagcactatatccaccagatcttataccaatagagcagtatggacgcttattgacagcaacctggcgatatgaacttggaccaactatgggaccagtattagtaagtagagaccttggatttacaatggattcaacaacaacaccagcagatctcgtgtatccaggaatgctaggaataatatatcgcgatagcagcttccaggccaagacagtatttataggtaatcctagcggtgcacctacaacacaacttatttacctcggatataatagcatcatatttaggggttacggtatcgaatacgcaatggtacttggggatgacgcacatatagtattttcaagctacagtgaagcaacaaggtgggagcaagatctaggagcatacgccaagaagaagggtatacagttgaatgtgcaagaggattgcgaatacacattcatacttgggacagtatacaagtattgccgggacggaactgttatgggcttcaagttaccaaaggatatgaaaagtgaaactaccccaaaaggtcagtcgattgaaagcgggtgggcgatgaatttagaatcaccatttgaaatagagcggaagactccacctgaaaagatacaagagttcaaaactaactggccatatgtacggctagtattcctgcaagagaacagatacgatattctgacagcaatcacgaatccatcaatatacgcaaaggcatatgagatcacagggtcaacgggcgacttaatacaatcaatgaggtcataacatgctgaagacatatctccgtttaaataacattcaattcctactactaacactcgcaataacatccacaaagtatggcgtaataagtcacatactctggataggtttaactatcataaatacaggactcatctattacagtattaagctgctctctaaaatacgatatatcagcacagatgccacaattggcctagtattcaaaatagcgatagacatttggttaacatggctagcaattagaaatactatatttttcctgacccccacttagtgtgtacccggacgccctggcccaggggtcgggtacgaaatgacccttacttggacgggcatggccaacccccc

SEQ ID NO: 743 - DNA, 4427 bp, Unknown
  derived from dsRNAs of unknown virus
gggaaagactggaagatgaagccataacttatcctatagaagggatcgcataggtcccggagtagggtaagaatggtagattccagttgcccccccccgtgccggacaaagactgaagaacacactaggatcgcataggtcctaaggcatagtcgcagaaccaagatcggtacggggaaatagggccaaagcgccgagggatgacatccttctcatagggtgaggggtcgggtaggccctagatccctatggtgaggatagatctacctgtcggaccagagtgaactcgaaacactacatgtcagggggcgcggttgtgccctatcgaacatgtagtgcatagggcaactggatctggcagacggcgcaccagggaagaaagaatataaaactatgtatcgacatatagagagagaaagggatagatgaggtgaggggtgcaaagaatgagtgagacggatcaaagacagggaggacaaggaaaggaaaccaacaaaagacaactaaaatcatacatcaagagagaatcaagactattagaagcagagttgctatcacgaataataccatcaagatcgtacattccgttagcattcatgctgatactagcaattctaggaatgataggaggctatgtgatgctaacaccaatagggatactacttggacagcagattttcataacatctatcggacaacaagcggcaatgacagcagtaaatgcaagtgcagctccaatggttgggaaaaccggggcagcggcggccgcatcagtaccagggagtttcgcagtatatgggatgatagccggtggagtaagcggagcactaggaggatatttgataggattaaatatagaggttgaatccaagttcaacaaatttaggaacttggttatggcagccgctatgaataaggtcgtggatgaagttgaggaggatgaagaatgataaggagtataagctataatagccagaataaaacaattcaacttggaatacaaccactaccactactttcaagctatgaagaagtaatgattgacgtagacggaacagtaatgtcagcagcacaatgggcaaataatcctaataataatacggtggaagttgaggtgtgccttagtccaaacgatgcaggttatagtagtgaacaaatcaactgcatacaaataacaccagcaaatgatgtcaatacgattaaagtgtggagcagaataaacatcggtggattaccagggattgctagcgttagtgtgactatatacaagaatgggcagtacataccagttggtgcaggtgaattaatgtacagtaatatcggatacgtgatagcgtacttagagctcctagttgggctgatcttcggtctcctgtatattgcggtgtaccaaaaatacacatatgggctctacatcatactagtgagttggctaatattattgggagtgggactgaataatggctatatgacatggattgcagacgtaattgcagcatacatagaatatagggtatacatcctatataaacggagtggagaagtgagctatacatttaggtgatagtatgttcgaaatatttagaaatgcggtagtggtaggcgtagatagtacaaacccaactaacaatcctagcattgttgtgcagaaatcagacggaactactgtatcaatatggatatacaagcggattgatgaaagactgtatcagtatacgaacggacaatggagtacagtagagtcgttaccagatggccttaatactgtactatcagtaacttcaccaacactggagaaaaagagggtcgcaggtgttataggcataagcaacagcagtggtccaatagcaatcaatgatacttatcagacgaagtatgaaatctatgttggtatgactggcgcaaaccaacaaggaccagcaaccccagtagcactaatggccgcaatcaagcacatagatagtatatggttgtcagaagccatatatggtatgtacatcttcccaggcatctattcagtcactgcaacagtgggaagtcaacaagtatcacaaacgataattccgtggggcttgggctatagtggaactatattaacaatcaatacctatatcctacaaatactcggaatactaagcacattaatatacgcactagacttaattcgcacctacagatctaacgacataaggaatgctctcatactgttgatctacgcactacttgggtatgcgttgactagcagtctagcaattggtatggcagcgatgctaccgattaacctggaatactatgatgctagtacgattgcagccgcaagcggattaattggagaaatacttggattagtgggctattctgttctgacattccaaagtgatctagcttatactaccagccaagcaatgagtcagtttacattgggagcagaactaactgcttccggggcaactattgcacaagcaggggtactggaaattgcccaatcactgagtattacgtcatttagtccaagtggcgtaggtcagggtggtgcagcaattgtcgacggtatatactatgcaatgagcagtctagtgttctatggactatcagcgggtacgatgactgttggtgtcatgataatgctcctacagatgctactcggttggggcctagtgctattggggatgtatattgcgaattcaacatttagaacgaaggtaactgaaacagtaaactatgcaacggagacagcagctactgcagctctattggcataagaggtccatttttcctagatcagaatataaagtagaagaatagaaaggagggataaagtatgtcaagtggatacccacaagaagttgtaataataggaagctataacccacaaaatgtaggagaattttatggatatgcatcagcattaatactaaccccagatggaaagcagtggcaaggatacatagatataacaaaggaagggacattcgcagtctacatacagaacatgagcatagacacctggttaaacaattacaacaattcgaaccaaccgatctcagtaacaacgactggaagtacaaccgggaatctaacatctggaatcacgtttgcaattgctccaaccggcagtcaagtatccattggtagtctacagtggaatccaagcaataagaaaatagatatcgtactcgataacttaacatccatactcacaaacccagatccatcaaccgaaccaacatgtctacagaactatgactacctggctgcaataatctacttcataacaccaagtgaggatctagcacagcagatatggaacgcgactcaatatgcaataacgccaatacaagaggcagcaataacctttatgggtatactggtagaaggtgcaaatggtatcggtgagccaggatactactatgatggttccaattacatagtcccacttatcattctgatcaacccccagcagttacagcaattcatatcaggaggcggacaatgtatacagtacccgaacacagaagggtaccagaccatcttctgctatcaaggtaacaacacatggaagatatcattacttggaataaccgtaaatagcaataccactctgacagttgcagtggccggagcatgaagacgaagtactactagcggagtaagagggggatgacctcacaagggatggaaacatacaaggccacctatcagacaattaatatcacaccgagcaatacaagtggaagtgggtcatcaggtagtaccagttctacaggcagcagtagcgggtcatcaacatctggcggaatgaagacattccggctagaatcacagacaattcagataacatcaaaccaacaaactaccccaccacagacatccggattagaagggtttaccttaaaaagccaggcaataaggatcactccaaataatgtacaaggatttaatacatacagcctggacgtaaagactatatcagtcacacagaatgaagcacaaggatttaccatatacagaataacaagcaagtctataagaataagtagtaacaaagtgcaaggactcactctttatcagatggtaggtaaaacactagcaatcagtctaaatgaggcaaccggtctgaatatatatcagctcgcgcagaagacaataacggtctcagcaaatctagttaagggattacggacgtatgtactgaatgctaagaccatcaagattaagagaagtagcggaagctgccagcctataacaataaaggcacattacaagagcatatgcacaatggaatgcaaccaaacaggcaatagtaacggcaatctcaatgtaaaaacatctaagtaggacaaggtagtagaaaaccctgggtcaccactcgagaagcctccatcgggtggtgatagggcttcttttggaggtagtaactctctccc

SEQ ID NO: 744 - DNA, 4417 bp, Unknown
  derived from dsRNAs of unknown virus
gggaaaggctgggaagtgaaaccacccagtgtagtggtaggatcgcataggtctgaacactacacgaggtggttaatctcagccacccccaggcaccatgatgcgtgagatccatggatgggtggatcgtataggtccatactatccatggtatcacaagtggcgcctggatagttaggagcccgaagcgcccgggatgaaggccctaaacctataagtaggagatcgcataggtctcactacttataggaggggtcagaccagagtccagtggacgatgaacgtaggtgtatggatgggactggtgcgtttgtaccagggaccatccatacactaaagggagaacccactgggcagggcgcactagggtggtgccgaataagtgggtgagaatatggaaaatcagaatcaaggccaaaatatgcaagacaatcaaaagacagagaaaagtgaaaggcagcaaaacatgcgagcacttgtgcgacgtgaagcacggctactagaagcagaacttatagcgcgaattataccaagcagaccatatataccgttggcactgatgataatactagcagtactaggaatgattggcggatacgtaataatgacaccacttggtatactattagggcaacagatatatataacatcaataggtcagcaagcaacacttagtactgtaaatgcaacagcagcaggaatggtaggaaagacaggagcagcagctgcatcatcagtaccaggaagttttgcagtatacggaatgatcgcaggagggatcagtggcgctattgttgggtacatacttggaattagcttcgaagtagaatcagcattcaatagatttaggaacctaataatggccgtcgtcatgaataaggcaatagatgaggtagagaccgaggggtgaagtgaatgataacaagtgtcagctacaataaccagaaggttgtactggggattcaaccactgccaatattatcaggatacgaggaagtaatgatagatgtagacggtactacaatgtcagcggcacaatgggctaataacccaaacaataatataatacaggttgagatctgcgtaaatccaaatgacgcagggtatagtagtgaagaaattaactgtattaaaatactaccagcaaataacgtgaagaatataaaggtatggagtagaataaacataggaggtctaccaggaatagcaagcgtcagtatgacagtatacaagaatggacagtataacccaataggagcaggggaactaatgtatagtaatataggctatgttatagcatatcttgaactactagttgggttaataatgggtctattgtatatggcagtgtatcagagatatgtctatggattgtatataatactagtaacatggttgatactacttggagttggactagacaatggatatatgacatggattgctgacataattgctgggtacatagaatatagagtatatgtgctatacaaacagaatggtaggataagctatacattcaggtgatagatatgtttgaagtgttcagaaatgcggtagtgattggagtcgataaccaaagcccaacaaatacaccaagtttaacagtcacaaaggccgatggtacaacggtctcaatatggatatataagagaatagatgaggatatctatcagtatcagaatggtcaatgggtaagcgtagaaagcctacccggaggagtagataatatattgaagataacatcaccaacgatggaacagaaaagagtagtaggagtaattggaataagtaattcaagcactacgatacaagtaaatgatcaatatgttaacaaatacgagatttatgttggaatgactgggtctaacaatcagggcacagcaacacctttggctctaatggctgcagtgaagcacatagacagcttttggatttccgaggcattatatggaatgtatatattcccagggatttatactataagcgagaacgtaggtggtaatcaagtatcacagaatattataccactagggatagggtatggtggcgcaatactaactattaatacatacgtaatgcaagtattaggactgctaagcactataatattcatactgaacttagtgaaagcatataggaacaacgatattcggaacggattaatgatactagtatatacactattaggatttgcattgacagaaagtcttgccattacaatggatgcaatgctaccactgaatctagagtattatgatggttccacaatcgcatcggcgagtggattaattggagaagtattaggactcataggatatagtgttctgacattcgaaagtgacctggcctatatgctaggtgaagcaatgagtgaattcacaactggtgccgagcttacaaacgcgggagcagctatatcacaggcgggtgtacaagaacttgtgaagtcattgagtccattatcatttaacccaagcggagtcggagccggcctgggtgcaatggtacaaggagtctattatgcgatgataagtatggtattctatggagtggcatttggaacggcagcggcaggagtaatagtactattaatgcaattagcacttggttggggactatcattacttgggttctatattgcaaacagcacgttcagagccaaagtatcacagactgtgacatatgtagcagaaacagcaagcgctacagcattactaacgtgaggaaggcaatttttgtatgcacgcacaaatttaaatagataatagataatgtacggagggataaatatatgtcaagtccatattcacctgaagttgtaatagtaggtacatataacccaggtgttgatggcgaatatgatgggtatgcagatgcactagtaataacaccagatggaaagcaatggcaaggatttattgctattacaaaggaaggagtatttgaggtctttatctacaatatgagcattgatacttggaatagcaactataataattcaacacaaccaataactgtaacagtgacaggtaatatcactggaaacttacagcaagggatgtcatttataatatcagcgactagcagtcaggtatcaattgaaggtctagcatgggatccaagtaataaggagcttgatgtaacactaagtaacttaactaacatcgtatcaaatccaaacccgtctgctgaaggcaatgggttactagaaaacctagatttagtagctgcagcaatctatttcataacaccaagcaagaacttcgctcagcaattgtggaatgcaatacaatcaggtatgcagaatccattcagtgtaccaattgtctttgaaggagtgttagtatcagggcctaacggaataaatcaaccaggatactactatgatgggcaaaactatgtgattccactcaagattcagataaatccacagatactgcaacagatgttatcagagggagcacaatgctttgcagggcctagtaattcagggtaccagactaagttctgctatctaggaaataatacttggaaaatatcactaataggtcttaccgtaaatgagaatactacagtaacagtagcaattgctggtgcctaaaatggcacaacaaggaagtggattttatgcgatccactttcaagagaagagtgtacaggtaacgacaagcagtggcggtaatcctccaaaacagagtgtcggctttgagggatttcgaaacatcacaaagacgataaatataacaagcacatctactcagccaactcaagtgggtttacgcacacttggggttataactaaatcaatacagataacaccgagcaggattggtctattaggttacaacattgagactaagtcgatacagataacaccaagcaagatcggtctgttaggctacggcattgagatgcaatcaattaaagtatctaagaatactaacattccacttcaagggtatgcaattacaacaaggtcactaaatatcggtagtaatacaaaattacaaacatacggaatgaagactaggacactagccattggaagtaatatatcaattaggacatacaaaagtacacagaaaagtattaatatatcaccggctaagaaacggataaagaaaagaagattattaacatttagcatattatgcaatgaaacatgctttattcaagacctgatatttgagaggtgagaaatatatgcctcttgtagtagccgaagtaagagtacccaaagtacaattctactataagatagtatgcggtgaagtatgtaatgagatagaacaacaaactagtgaggaacaaggaatactaggaatatttggctaaagataatgaaggcccaccctgggttgctgcccatggaccccacgggcagcaataggggaaggggttttcttgaccaccc

SEQ ID NO: 745 - DNA, 4398 bp, Unknown
  derived from dsRNAs of unknown virus
gggaaagactggaagatgagaccatactgtatcctacggagggatcgcataggtcccagaagtaggaaacagatggtcaattccagtaaccccccagtgtctagaaagtaggcactgaattaaaaaccaaagcgccgggagaggaaatccttgccatggggtgatgggtcgggtaggctctagatcccaatggtaaggatggatccatccgtcagagctggaatgaaccgaagtaccgcatgccgtagggcgcggttgtgcccaaccaggcatgtggtatggagggaaccagttatgacgggcggcgcaccaggggcgaagataaataaggaagaaagggataaaggtgtccatgcagatagcaaggtgagaaataaataaggaaaggtgccagctatgagtgaacaaaatcaaagacagggagagcaaggtgtaaaacaagataccaataaaagaccactaaagtcatatatcaagagagagtcaagactgctagaagcagagttgttagcgaggattataccatccagatcgtacataccactagcattcatgctgatactagcaattctagggatgataggaggatatgtaatgctaacacctattggaatcctccttggccaacagatctacataacatcaatcggacagcaggcaaccatgacgactgttaatgccagtgctgcaccaatggtcggaaagtcaggagccgcagcagcggcatcggtgccaggaagcttcgcggtatacgggatgatagcaggtggagttagcggcgcacttggaggatatctaataggacttaatatcgaagttgaatctaaattcaacaaatttagaaacctggttatggcggcagccatgaacaaagtggtagatgaggtggaggaggaggagtaatgataagaagtataagttataaccagcaaactaaaacaatacaacttggaatacagccactaccattattatcaagctatgaagaagttatgatagacgtagatggtacagtaatgtcagcagcacaatgggctaataatccaaacaataatacaattcaagtagaggtctgccttagcccgaatgatgctggatatagcagtgagcaagtgagctgcatacaaatacagcctgccagtgacgtaaatacaatcaaagtatggagtaggattaacatcggtgggttaccaggagttgctagtgttggtataacggtatataaaggtgggcaatatgtaccagtgggctccggcgagctaatgtacagtaacattggatacgttatagcatacctagaactcctaatcggcttgctatttggattactctatattgcagtgtatcagaaatatgtatacggactgtacattatactagtgacgtggctgatactactaggagtgggcatggacaatggctacatgacatggatcgctgatatgattgctgcctacttagagtatagggtatatgtgttgtataagaggaacggtgaagtaagctatacgttcaggtgatcagaatgttcgagatatttagaaatgctgtagtagtcggtgttgataataccaacccaactaataccccaagtgtcgtagtacagaagccagatggaactattgtctcggtgtggatctacaaacggatagacgagcaattatatcaatacgtgaatggacagtggaatacagtagattctctaccaaacggtttaaacaccattctatcgatcacttcaccaacactcgaaagtaagagggtagctggagtcatcggtataagtaacagtggaggtccaatagttgtaaatgatatataccaaaccaaatatgagatatatgttgggatgacaggcgcaaaccagcaaggcccagcaaccccagttgctttaatggcggccattaagcacatagataaggtatggctatcagaggcactatacgggatgtatatcttcccagggatatattctgtaaccgatacggtaggtagtcatcaagtatcacagacaataattccatggggtctaggctatggcgggacgatactgacaataaatacttatatcatacagatactagggatattaagtacctttacatatgccctaaacctagtaagagcatacagatacagtgatataaggaatggcttgatactactaatctatgcattgctagggttcgcattaactaatagtcttgcaatcagtatggctgcaatgttaccagtaaacctagaatattacgactcaaacagaattgcagcagctagtggcttagtaggagagatattaggtctagtaggctattcaatactaacattccagagtgatatagcttataccgcaagtcaggcaatgagccagtttactctgggagcagaattaacaactgctggtgcagccatagcacaggcaggagtacttgagattgcaaagtcacttaacctaacttcattcagtccaagcggtgttggagagggcggtgcagctatcgttgatgggatatactatgcaatgagtagcttggtcttctatgggctctctgcaggcacaatggctgctggagttatgataatgttactgcagatggtgctcggatggggtctagcattccttggcatgtacattgcaaattccacatttaggactaaagttgctgagactgtgaattacgtcactgagactaccgcaacagcagctctgttggcttaaggtatataatttcttcaaccaatgtagattttacaacttagcatgaggtgaaaatatgtcctcgagtggatttccgcaagaagttgtaataattgggaaatacaatccacaaaatgtaggagaatactatggctatgcttcagcattgataataacgcaagacggaaaacagtggcaaggctatatagacattactaaggaaggaacatttgcagtaactatccaaaatatgagtgtagatacatggcttagcaactataataattcaagccaaccaatctcggtgacaactactggaagtacgactggtaacctaacatcaggaattacatttgtgattctgccaactagcagtcaagtgtctatcggcagtctcgagtggaacccaagtaataaagaaattgatatcgtactagacaacctcacgtcaatcctatcaaacccagatccttcaatagaacctacttgcctacagaactatgactatgttgctgcaatcatctacttcatcacaccaagcgaagaactagcccagcaaatatggaatgcaactcagtatgcaatcacacctgttgaagaggcgccaataacctttatgggtgtactaatagaaggtgcaaatggtatcggagagcccggttactattacgatggctctaactacgtggttccactcataatattaatcaacccacagaagttgcagcaattcctctccgaagggggtcaatgtgtacagtatccaaatacggagggctatcaaactatattctgctaccaaggtaacaacacatggaagatctcactattagggataaccataagtaacagtactaaccttactgtagcagtagccggagcataagacaacagtaatgatagacaatttaataatggagcaggaggttgatgtcctctcaaggaatggtaacatacaaggtaaactatcaatccatcaacctatctccaggaagcacaagtgggagtggttcatcaggtagctccagttcaggtggcactcagggcggcaatggaggatcatcaacaccagaaggactgcaaacattcagcttaaaggcacaaacaatacaaataacatcaaaccagcagacgactccaccacagactgcaggactggagagcttcacacttgaaggtcagactataactatcacgcccaacaatgttagtggaatcatcacatatagcttaacaagtaagaccatacaggtgagccaaaacgaagtgcaaggacttagatcttatagcatggcaagtaaatcaataactgtgagtagaaatcaagcacagggacttgagtactaccagattattagtaaagcactaacagtatctagaaacaaagtgaatggactaagcacatatcaattaactcaacagactataactatctcagcaaattatattaaaggatttagagcatatgcactgagtgcaaagacaataaaggtaaaaggcaatgtcatcacatgccaaccgataactataaaggcaaactataaggggagatgtacaatagaatgtagtacagccaactataaagcagttagtctggcatataaagaggaagaaacgataaggtaagaaccctgggtcgccacccgagatacctcactcgggtgacgatagggacctttttgaggtaaacactttctccc

SEQ ID NO: 746 - DNA, 4302 bp, Unknown
  derived from dsRNAs of unknown virus
gggaaagtaggaaagatgatgatgcatttccagcccgggtaggccggtggccaaaccgggtggttaatgcatcagatttccgaaatcccacgcaagtaggcgatgcaggtggtccacatctgatcgggacgggggggcccctaaccgatggatgtgggccattaaaggccgaaagcgtagaggtgggagtatgtcgatgcagcctcaaagaaataatagtcaaaacgacgagcaaacatatcaaaagttgctagaagcagtagaacaactaaaagaactaatagaaagacagcaaaccaatgtacagcaaaatgataaaataaacaagaacggacaaatgaaaagtctgttatacgcagaggcagcattagtaaaaagccatgcattgatgaggttaataccaagacagtcaacaattccagtaataggcttgataataggaataatgttgggtgcatatgttgggctagcaatcgcaggaccatttggaacagcattggcagcacaagtatataccagtggaatgagcgaaaagattgcaatgagtacggtcaatgctagcgccgcacaacaagtaggaaaattgaatactgcaaccgctgcgacagtcccaggtagtgtcgacatggtagggctaactgtaggaggtctagtaggtggtttcattggatataaaggaggacaagaactgctaagagacctgaaagagggtaagttagaggaagtgatattagctaggacatacaatgagttagttagggaggttggaggagaggcggcatgaatatggaaccagaaaattatcatgcgttaataaaggtattggagttttaaaacggaaaacttcagggtgagagaaatgataaccgcagttcaatatgataacaacgataatgcaataattctagagattaaaggattgccactaatgtctaactatgaagaagtaatgatagatgtagacggtaatatcatgtcagcagcaaaatgggctaacaacccaaataacaatactttacaagtaaaggtgtgtctaagtccaaatgaagcaggctatagcgatgaaagcattagctgtctgaagctaataccaagtaatgatgtaaacacaataaaggtatggagtagaataaatattgcagaaatgccaggaccagcatcattaccattaacggtatacaaaggaggagcttatcaatcagtaggtgcaggacagcttaccctcagcaatttagggtatgttatagcatatataatgctattaatcggcctaatctacggactactgtatatggcacagaagcaatatgtctatggaatgtacgttatcctagtgacatggatgatattgctaataggtggaatgaacaacgggtatatgacatggcttgcagatgtcgtcgacggcatcatagaatataagatatatagaaactaccaggtaggaagagtgagttatacattcaggtgatatgatatgtacgaaatctataagaatagtgtacagataggtgcacttccagcaaatccaacaaacaatccaagcatggtaatacagaaacaggatggcacggtggtctcttggtggatatataagaaagtcgacgaaaactattacttttatacaaatgcgggagaatggcagaaagtaaatagcctaccaagtggggtcaaagtaataatagatatagtatcaccaacgacagaaatcaaaagagcacagggtgcgatagcagtaacagatggagggacaataccaatcgatgacaagtataagagtagatatacaatatatgtagcagcaactggcgctaataataatggaccagcaacaccagcagttctgatggtaggtatacgtaacatagacgatgggtggttgtcaacagctatctatgggatgtacatatttccagggatatacagcgttgaagagcaaggagtaaaccagacgataatgccaatcggaagtggatatggaggcacaatattaactattgatacatacgtaatacagacaatcggcttactagcattaatattctacctattggacctagtaaaggtctataggaacggcgacgtacggagcgggctgatgctattactctatgaattcatagcttacatcctgacggggagtctagcgattgcaacggcaagtatgcttccaaacataatagactactacgatcttggtgtcctgcgtccagccgcagggttcataggaatggtcatctccgcagtaggactactgatgttaacagttgagactgcattagcatacctggtagcggaagcagaagcagcattcagtacaggcgttgaatatactacatttggtgcagcactgtcacagagcggatatcagacattaagcaacgtaaatatattaaacttggggtcattaggagaagggataggattaatgacagctggtatatattacgctatgatcagcatgatgttctacggactagccgctggtacaatggccgttgcagcgggtgtggtagcattgcagctggtattgggatggggattagtactactaggatactatatcgggagcagcacggtaagacaacaggtaaataaggcaaccatagagacaataaatgcagcaacggcgctaggtatactggccacataaataaacaaagaaatcctactttttcataggcgatcacaaagaagtaatcctgaatgaatggtgggctcatatgagttctagtccacaagtaattgaaattattggatacgtgaataatcctgatggtttttggggctcaggcagtggtacattaataacaccagacgggaaacaatggcaagcaactttttccataggtgcaaaaggtagtctaagcatagtagctagcatgacaccatcaatatggctaaacaattataacaacagttcaggaactttcacactgaatgtagagagtgtaacagcaggaaacattccaactgggagtacagtgacatttacactacagccatcagcaatgacggtgaatatatcatctgggagtaattcagtccagatcaacctagggaacatccagtcagaatatggtacgaatgagacaggcgcagtacttttatattcaccaaaccaacaagtaatgaatcaactccaacaagcattatcaacactaagccaaaagctcataggtcagaatccgaacctatacttctccgcatcagaagtattccaagacagcaataatggacaatactatatccagctatcaatctacggaccccaaccaggaagcagtggaagttatggcttatcagtacaggtaaatggcatgactgcaagtgcatcagtacagattaataatggtaatggaagtctgcaattatcagtaaccggcctcgatactggcggacaggcagttacaattactgcatacgcggcaggatattaaaaggatgacggaaagtaaataggggagtttggtactaatgcctgataggatagtgatagaaagggaaggggcgggatacaagtatgtgacaccaaacaataataataacaataatagtagtagtggaagtagtactaatacgtcaccgggaagtaatacatcagcggctttacaaggaataatgtacagctacaataaggatacaacagtaacaaaagtgtcaatacaaggaacatcatatggttatgaagtagataagacaactgtacctatatcaatcagcggcagtgcgtacttatatagtggagatacaaccattacaggggtggaaattaaaggagatgtcttcacatatgaatacgacagtacaaccatgcagacacaattgcagggagcagcatacaaatatagtatacgactaacgaccacacaactaacggtcagcggatacgcttacaggtatctgcaagaaaatacgataaccccaatgctacttagcggctccgtatatgcatatagagaagaaacgacagaggtaggaacaagcctcaccggtaaggcatatacatacttagagaatactacgaaaacgacgcctggaataacggttagaggatatagatatgtaaaagacagtacagtcatcagcagaacaaaagtcgtagtcagtgagttcaaggtggcatgcggatcatgcagtggacaaagatatacaatacattgtaatagaaaggaacaacataagtatgcaatgaaagcgatgtactacataacagacccatttttataacatactcccacaggatgataccgcctctgggcccggaggggtagaccgtaaaaggggcactagtaacccccc

SEQ ID NO: 747 - DNA, 5953 bp, Unknown
  derived from dsRNAs of unknown virus
ggtagctgggcggtagggcacgttacaccaccggtcaaaattcttgtggcggggcagcaaaatgggatccggttgtagtgaccacccaccgggtccccacaggacaccaaatatggtaagttacggcactgagaaatctattatacgcgggggggcctaaggtgggtgttctatatgatgtcctcaggggaagtatcaaaccaaatagatccagaattaagtaatacatttttattggaagaggtattcgagtgcgcaggtctagttgtaatagatacaaataagctaccactacaggaagggatatataaggccgtctatgtaaaagacgaagaaactggtaggatcttagctcggtatggtgcagtaggtatcgaaagacttcctaagaccggtaggtacctaatgagatataaaagtgaagcaagagcaagcgatgtaccaacatttacaatactgacgcctacaaggataatagaactgccgtatgacagggagcttgaactggtggtgaggagggatgactaaagggttacgggttgtaaaagcaacgaagcctattaggctaccgattgatgatgtcattggtgaggtactagcacggccagagattgtgaaaatgataaaggttaatggcagaatagcaaagcaaggaaaacttgaacagatagtcttaccaaaaactgtcgaagggacggagttaataccagtagaatatatggacttgttaaaggaggttggcgtagttgaaaaggaggacgcagacgtgatgtggatcaatttccagaaattgcaagctcttaggacagagagtgaggaggcaaagaaatttatggaaactattgctacaaaatatggaatcgacgtgaaaagattgctagcacaaatagaaagccttaaagtgatagtatcagaatgatactggtggagtggtagatatgcacatctatggtaatcttagtatatcggggctcgagagcagacaacgtgtattcagaggcaatagtgttcagattacattcaacgagccaactaagttagaatacctactaagatggaaagcaaaagcaattacatatagtcattataaggaattgtttaatatagagaaaattgaagaacaattatatgacgaagtagagaaagctagttacatgctgaataaagaggcattcaagaataatatctatagctatatctatcaactgcatgtcaataagctatatctaatcctagcaccaacagtattaacatacataacctctgaaggaataccacacctcgatatcggtgatacaataatcgtcgatggtatgaatttaccactgacacaatatgagcgtggtatactatatagtatggcatggctatatacaggggtttgggatagactttcaactatcatacatgaattgattgccttagctaagaacggaaagaatgggattcagctcttacttactacaatgcaatccgagctacaaagtcagtatgtacatgaaaatgatattacggagaaggcaagaatactatatagagtagcattagttaattacattggcgaagagcttactaagatcagtgatctaatgaagaatgctagtcaaaagatgaagagtctatcggagttccagtcgaagtggacacagctcattagcaatatgaggaatgagctgacgaagataataagacatgcagcactactaggaaagctaggagcggggagcgatattgaatggtacaatgcaaatgttattacagaaagagttgatattaatggtgctaaggtggaggtcgtaaacctccttaactatacagttaatgaccaacaaagtagagtcaaattccaccttggaccctctgctgaaacggtacatgcaagcctccttgcatatgccttaacatcgataaattatagtgatttagaaagcctgttcgagggaaccgatgctaagaaacaatatgagaatgttgtacaggttataaagagggtattcggattaatagcaacattagcgttaactgcgagggactgcaataatagtatacaattgtcattagaagcaatgtcaagctacagaacagaagaagggattgaatccgctgcaaaagtactcaccgcattaattgatacagcgaatatgatcagtgaacttggtaggagtacaaatattagaccgataatacaggcgaacgtattatatacaaacatgatgccaaataaggtcatccttcgtaatgaagtagcacaggttacatacccattcattatgactatacgtgctgagcatgggctacgggttgtatatagtatcccaggactaataggccttagtaagcagggagagcttgagtcaacagtaagtaccgacacagtcttagtagtgaataaagaaatactaagtccaaacgaattagctctacctgtagaggtgcatgagataccgggtagtgtagtggaagtctcaataagaagtcttgagatactaccagggttaccagactatctaagggagtacaaagtacagctgcccaaagtaatagctgaagagttcaacaagatacggctacagctaagtgaaatcttcgagagttaccgtcatcaagtggatataagagcactaagtgatctactgaatgcatatctagagttatcacggataataatacgaagactaaacactgacaacaacggaattattaagggtgtagcaataattagcacaatattactgggtgtagccagtcagaaacaaagtatacgaggggctgagaaatctatctatagcagtgataagatccttggaatactcacactgaatctaattgccaatcgttacaagaatcaattgacaaacccaccaaacatattgaacttagatccagacactacaaccattaaggtcgcaatatatgacgagaatcacggagaggtcattctatccgatgaagctaagccagtgaaggaagcaaataggagaagtgatacacctgaaagctacttcaattacataccaaacctccctgatggtcctaagaaactttatcttgacgctattgcagctgatacaaatcctgaagaggttcgccagttattagagtcactgcatatgaatattgagggcgtaatgggtgatatagccaagaaatctaaattcaaactagaggcgttaacaaccgaccttggaacagtattatatccggtagaacaaatgataagtaacatactgcaatctatccgcagtactggccgctataatgccgcaatatcaagtatagttaatgattacatgagtatgatcgataagaccgctgagattgtcttggacaccgaatctactatcacaaagattatagggttgtatacggatggaagaggaggaggagtacatgatcacttggaactacgtcttgcaccagcatttaggtttgcgatagggacagctagaaaactcgaaaatatgagtctacgcatacaactggcaagtgagtgtgcgggagtactaatcgatcgtactagcgttgatatgaatagagtaccatacacaattgcaccaattaacccagtaaggataccaataaagcaaggcatagtcgagcaggtatcattccctggtgcagtatgccttgcaattgatgcgaagaataatatggtgaaaccagaagaggtgcaagactactacagacgtataacaagtgttggaggtcaagggaaaccgactaatcaaggctcagcgagtaccacgactcagcagcaacagcaaggatcagccgcatctgaaacaggcactggaacatcaggagctaacacaaatgctcaatgacatatatcactggtgtaattaaatgacagctgatcaagtgactacacttcgagagaatgaggtttaccagggacactttttatcactttatataaggagatacgatttgacggaattccataatatgtacataagactaatgcggaagaaatatggtggtaagaaacctgagatcgcatgcgaaccactcacagtatatacaaggcatgccgtagtatctggtcacgccgagaacattgggttagatatggtaattaaaggccactcagaagcagaatttattccaactattgttcaggactggatcgaaccaatgatggatctgatacgagatactgataaagaagaaattctacaaatgggttcagtaggcggttgtttccatgatatacctaataagaaagttggtaaattaataaccgcacaatatgaaatagaacaactacaagtagacttcaatgcactactaatgtcgaaatatctaaaattaaaacaattactcagtgggttatatcagtatactgagattatttaccgtgaagcagagaaagctatagaaggtaatcaaagagacatgttactctatgggactaaacgaccagaagcagggactgggattagaattggtggttttagtacattaggggatttattacggtatgcggataatgacactttactaaaattcttagatgatgccaaagctttagccttagctgagttacgtgccttcgaattattcttagatagtagggatccaactaaggcattcgtcgtagagattatatcggatggatatagaggcagctatggagtacgtagtgacatagatcgtgagaatgtttcaatactagaaggtaaagaacgctatgattatgaatcaaagactagagaagttaatgtgttaacaccagcaagcgcatttagcaatgccaatctgaataatgttacaaaatcagctcgaagatacatatatagactagcatcaaatcttcttggtttcaatctcgcagcacctgatattattagtacagaacagtatctacggttattaacacagacggagaggtacgagatcacacgtggagccgggccagtacttgtgagtagggatcttggatttacactaaaagatacaactacaccagctgaccttgtattcccagggggtataggggttatctataacgactcatcactaacaccacgagcaatatttgttgggaacccatcaggtgcacctacaacgcaaatcatctacttgggttataacatagccgtatatgatggttatcaggtagactatggaatggtattgggcgatgatgcacacgtcatatttagtactactgaagaggcgaagcgttgggataaagatgtaggggccatatttacaaaagccaagggtcttacgactaataatgatggaacatgtgagtatacctttatactagggacagtttataaatactgccaggatggtaccgttgcaggttttaagataccgaaggacatgaagagtgaaactacaccgaaaggtggtacagaagaaactgggtggctattcaatgtcccaccaacattcgaattcgaacgagttacaccagaacaaaagatacatgaattcgagaaccaatggaacatagttagaatagtgttcatgcaaagaaacaggcaagaagtcgaattagcaatcacagacccaacactttatgcaaaagtgtatcagatcactggatcagcaggagactttattatgagtcagagagtcggggagtagtcgtgagtagactgttggaaaggttatcgtatagcagtagtattcaattcgttctgctactagtacttatcaatcacatcccgtatatcgagttagcaatagcacttggaatcataattacaactatctataatatagcacttagcattaagatactctactacttaataaggatatcaatgaactatgccattagtatcatgttaaagattgttgctgacgtgttaataatgaattatactatacatgtattattagacatgggtatacatgcaccctgagggcagcgggttgggtggcgggcttgccctaacccgttaagttaattaaagccctttattttagaccc

SEQ ID NO: 748 - DNA, 4620 bp, Unknown
  derived from dsRNAs of unknown virus
gagaaaataaagaaaatagaaaacataagaagagaagattaaaactgtgtaatgccaagtagtggcgaacctatcgccagcacaagtctggataaccaaagggaggagtccccgatagctgaaagccatgaacggcatatcacagtaaaagtaattgatttttgaggaagtggtttggttctgaaaaccactggataataaagatagtcgtataatatgtatgtatatatgtaagatataagcacaagataggagtgatgcatatgtcatatcaaaacacaagtggaaataagtcagaacaaacagaagttgaaggaaggaaaggaaagcaacagggtctgagtgttcacatcccagtaatgatattgctgatagcaataatagtgataggcatgtatgttggttctgctgtggggacacaattaggggtgatggcaggtgcacagatctatatagcaagcggatcggagtcaattgtgctcaacgccacacacgagggaacattggcaaactcagcactcaaggaaggtgcggctgaatctgcatccacaatagcatcctggacgatacttgggactgcacttggtggagttgcaggactagtggctggtattgaactagtagtattatttgaaaaagcacgtcgtgcagtttcagagggaataaatgggtgagaatatgattacgacagtagccgggaaaataatttcaggagagactgcgggaagtgaaacgggtttaatggaggaatacaaaggatacaccgatgttatgaagacagcagcaaatatttatgggctacccggagttggttcaatggaggactattatgttaaaataacggtgaatagtaaaacatatgagtattcactaagggaacttatcataaagaacaaaaatggagaggcagcagtaataaatgataacggcgtgtatttagtggtaacggcaaaagagtcagcaactcagacaagttatggagatagcgacgtagacattcagtgttataatgtttatcttgctacatcaaaacaaggaaaagtggacatagcattctactcaattatgaaattgcttggaactattggaccaacatccttgccaagtggtgtatcatatagcatagatcaaattggaaatgtgtcaataagaggccctaataatgaagttgtgttcacactacagaatctgttctatctcattgcatatgtggagctaataacgtcagtactgatattactttacttactgtacataaagaggacaacagctgcaatagtatacttcctggttgactatgcggtgctaagtatagtatcactaaacaatgggtatgcaacagtagttgcaactcttgcagttggatacatagagtataaagagtacaaggaaatagtggcaaagaggtactcattaggaatgggaatagtaaataggtgagaatatgtttgaaagatatgcatattacgcaggagtagcatatcagccagcaccacagagcttagcattaggtggacctataaataacaacaattgcacactgaaaaatccgctaaacttatcacaatacgtaatgacaattacgggggataatggaaatatgcagacgcaggtattacctatatatattattgatggaaccgaatacttatacaatccaagcactaaggagtttgtagaggcgaatagtgtagtgccacttccaatattgggaaactgttgctttacaccgataaataaggttttatcctttgaatctgcaactgatgaggagaagattactgtgctggggattgcaggtacatttgctgttcagtcagaaaccaatagcggagtgctatctgcgaatcagtatgcgggtcagatagtaaatggatattcaggaattaaaatcaggtggcataagaagcttgaggtatattattactatgttactggcagtgtaagcaatgctctattgcaacaataccaagacaacgtaacagcagtatctgcgctaatagcaataggaatgtacacaaacgataatggactgtactggacaagagcatatgcccttcaggttgtaacaatttatggagtatcacaaactgcaggggccactgaagtgcaaggaggacagctgttgacattaaatgctatagtaatttcaatgatagggatattaggaataatagcaacaatattgacactggcaagagcatatgggcgcaaggagtatgttacaatggcttctctactaattccaatgatagcaggatacgcattgagtggactacaactgtttattgggatgacagcaggaatatttggcgcaattgaatactacctttatgataagctttctgtgctaatactgttggtctctgagttggtgtatgtcgttgcagcagggatattagaatttgcgagcatgtacgaatttgcagaattccttgcgaatactttattcacagagtccataatagatttcctgattggactgtctgatgttactgatttcagtgtaacaggccagataacgactggggaagctgggattccaaatggattcacaataagtgcagactatgaaacactagcacaaggtatactgttcatggtgcaaggggctctggacttcctgtttgcaaatgcagcaggcataacgggaatggtgattgtagcgactcagttagtattgggatatggcctaataattgctgatgtaatgtggacatcagttgtacctgcaggtaagtatgaaattaaaggggttctcccaagatattagtttttccacttgtgtaataactggattaaataaagaaagaaaggtgtaaatatgcagataataggtttagagtccatcccatgtgggtggtcacaaagcacaaatgtaaatgtttcatataatggaaacacatatagtggaatgttaattattgacaataatgcgaaggcggcaacattaataataattgataaaagtgtatcgacagtatttagtagtggaagtgtaacagtaagtccagtgtcaggaagtgaaccaacatttacagtaaacataaatcaacaagctcagtgcattatatcagcatcagcgagtggactaaagatttcaatagatattaatacgttcaccgaagcactggggtggatacagctagaaagtacggatcagtcattaatatcaacactttataataatataacaagtgcacttggcaataatatagtatatgccaatgaatcacaggaagatataaatggcaccacttactattacgcggcaataatattaacatcaccaacatcacaagtatcagtgtcagcacagggaaataacggggacgagttgtatgtaagctcaggaacagcttaatacggtaataataatgcaagttattgatatatttggccaaccatcaggatggccacagcagataccaataaatgaaccaggtgtgccagtcaatgtagagctaagtaatgggcaaacatttaagggacagctatgggtaattggaacaacaaattatagcattctagcagtatacacagatgaggaaaacgcaataacgccagatggacaagcagcaacaatatcggcaataaatggccagtacccatcattcacaattgtgattaaacaagcggatgtcccaatgtctgttactgttgatggtggaacggtaactctaacacttaaggaatggccagtgggagatgaagcgtatataatgtttgaaagtacatgtcagggcattctatcagacttatatacagtgataagtaaaacttggaaaccaggttatcaactagtgtatcaaggaaaaagtcccgtatcgggactttattatctaatacttgggactaatggatcagaatatgtgccagcaacaacgcaaattaaatataatggtgtactttattatagctccggatatcagtcatcctcgatatatcagcaggaacctttcttagcatatacatcaattgtagagaagactgcaataaacggcattcctccaataggtacatatcagtcgataagagtattaacattagaaaatgcagtaaatggattctataatggaattagagttgtaggaccattaagctatcagcagataacaggggaaataaatgcaaatgtcactaaactaggaccactgtcatcagcaccaataggtggtatatatagagttgtgggaaaagtagggccaataagttatcagcagattacaggtgaggcaaatgaaaacattatcagattagggcccctaagctatcaacaggttgtaggaacgagtaacgggaatatcgtcataataggaccaatcgaatcgaaaataataaatggttggtataacaagattactctaatggaattagaacaaagacaatcatcagggccaccagtaccaccaccacgcccaccaccgccgaaaagagtagtgaagaccatagaaatggcgagctgctgtgatggcggaaatatagaggaaagagagtgttttaataatagttgtgagtgatgcattcactcacaagctggggttggatacaccaatgacacattatgggggtgttcgaggtagcgtccaaccacagtaaccccaaacaggtttccttccc

SEQ ID NO: 749 - DNA, 4272 bp, Unknown
  derived from dsRNAs of unknown virus
gagaaaataaagaaaaagaagaagaatgctaagacgatacattatatggtgtacaaagtacacctatcaccaaagcgaaccatgcgccagctggaatgctggatacacaaaaggccccaaggggtaccgcatgctgaaagctgaggtgattaagataaatgtttttatttatatgtctaactattaaagcatgtaagtatatataaaacacaaataaatgagttatggaagctaggttatatatatattctagagaaagtgtatgtatacctacgtgggtgaaatatgtggtggaaaacattcagtcaaaaggagatggagataaagctggaaacgaaaatgaaggagaaaagagtgaggtcaaggcagttaaacaaacagtaaatcaaggaaaacaaagggtgttgtatagaatggctaacagtcatataccaattccaatgattataatgttgtttgcaatgataataatagggatgtacattggagcatctgtaggaacagagcttggtgtaatggctggtgcacaagagtatatagctggaggttcagaagctatagtattaaatgcaacacataatcctggattggcagattcggcactgaaggaagggtcagctgaagcagcatcaacaatatcagcatggactgttttaggagcaggaataggaggtgcagcaggtttggtagcaggtatagagctaataatgatacttgaaagagcaaggaaaacattgtacggggtaggtgaataatatgataacagcaattagagcagatatgatcagtgccagtgaggcacaaactagaagcggtgtaagcggcttcaataatttacagaatgttggcgaagtgacaatgaatatatatggtctgccgggtgttagctcaatagaggagtatagtgtcagcgtatccataaatggacaaagctatggctttaatctacgtgatctgatactaaatactaagaacggtacagcaatattaaaacaggttactaatgggaattccctaattgttgctgcaagtgagtcagcgctggaaaatacatttggagacagtgacatcgatgtccagtgctatcatatttttgtgggatatactggccaaggtactgtaaccgttgaggctcaaagcaacatgaggctacttggggaagtgggaccagagtcactcggtgcatcagttagtttgtacttcggtcaaaactgcgcgtcagttaaaaacattcccagcaatataatattgactctgcagaatctcttctatctaatagcttatgttgagctgataatagcagtgttcatgctaatatatttactgtacataaggagaacaggaccagctgtagtgtatttcattgttgattacctaatacttgggttactatcattgaacaatggttatgcaactgtggtagcggtgttagcggcaggagtactagaatacaaacaatacaaagaagtgaagggtggaacatatcgctatggaatgggtatagtggtgaggtgagaggatgtttgagtcatatagatactatgcaggtacagcaacccagacttttccaacgagtaatgcactcaatggccagggcggtaatccaaactgtccgacattgcagttgtgtccatacgcactaacaataagcaatggtaaaatgggtactgagattaccataataccaatattcgtaattgatggtgtagagtatctgtataactttaatgttaaggaatttaaaacagtgagtgaagcaacaggtggagcaccaacattactgggatcatcatgctatacaccggtaaataggatagcagaactagagtcagcaacagatgaggaaaaggaactcgtggtgggtatagccggcatgtttgctgctcagtatatatcgcaagcaggtactacagtaaacaattaccagggaactaatgtcaatggctacggcaacgtgaagataaagtggcataggtcattgaaaatatattattactatgcagccgctagcgaaggaaatctgaacacgaataatttaaatagtgtaatagctgcaatagcaacagcaatgtacaacaacgattcaggactgtactggacaaggttctatagtatacagatagtaacaattggcggaaatgtagttgtgagtgcagcaagtgtaccaggcggcagtttattgacattgaacagcataatattgtctttgcttggtatattgggaataatagggatgatactagtaatagccagagcatatggacgtaaggattacgtcacaatgctttcactactaattccattcctcactggatatgcattgagcgggatgcaactatatgtaggcactgccgtaggattatttgctgctattgagtattatttatacgacgcattatcaataatagtcttaatgatatcagaaataatttatgtagttgctgcaggaatacttgagtttgctagtctatacgaattctcagagtttctgtcaaatatactgtttatacaatccgtttcagacttcgtagaaggaatagaaaacatagccaacttccaaataaccggtgcgattacaacaacagatgatgtaattccaacaggctttaccgtcaatgcaaactaccagtacatagctaatggcttaatagatatagtgcaaggttcactagatttcatatttgcgaatgcaactggaattaccggtatgttaattgtcacaatacagttagtgttgggttacggattgctcgccgctgatacaatgtggacagcattggttccaagcaagaaatatagaataaatgttccttcactgaggtattaggaatggaaaaagaaataatgatgaaggcaaatacggtaggtatacataaagaagtattgtttttagaagtgggaaccactaacagtggtgcccacagtggcccacacaccacaatatgtgtggaataataaagtcaaggtgttaatcatgcaggtaataggtttatccactcttccatacgggtggccaggaaatttaggtgctacagttccagtttcagtgcagtacaatggaaatgaatacagcgggacatatgtggtggcgtcagatggtagcgaagcaattgttatagaagattccagcctatcaacacttataacctctgggacactaacaatagtagataagtctggtaacaattaccctacaatacaagtgtcaatgtataatactccagtgaacccattaggttcagtacaagtaaatgggcctgcagtaaatataacaataggtgacgtatcaaactatgcctggctgatgtttgaaagtacagatgcagcattaataaataatattaaagcaagtttgagccaagcaatagagcaaataacatattcagcaactggtactgagaccataaacggtcaacagtatacgtggttggttataacatatgttggaaatgttaaacaattccaggttcaagcaacaggtcaaccaggagacatactatattatagtacaggggtaatgtgagagtggtgtatatgaaggaatcaggttatgcaaataagatagttggagacatagcaaaaggtgcagaaaatgcgatcaaaaggcttataagtgtaataacattgcaagtggtgatacaaggatacagcatgggatcaatggttagtaaagatagtgaaatacaatgagcggaaatgcatcaagtgcagtaggttactatagcccaattggatcagttaaactaacagaagggtcaagtggaaatactgactcaactgcagtagggtattatagccaaactggctcagtaacattagtggagcaaacgataagcggctattatggagacattaaagatattaagctggagaatgttcaagttgtaggctattatggagaaattaatgaggctaagttagtagaacaactgttgaatgggagttatagcaatgcaaagaatgttaagctaggctacgaaggtgctgtaggctattatggaccaataaataaggtagaattagaggaacagataatacaagggaaatactcaattattagaagcataaatttacagaatccaccgcagccaccacagaaaccacagccactgccaacgcctagaccaatcagaaatgtggcagcaggaaagcattgtgcatccgataaaaggattaacacctcaagctagaccactattggtgccaatgaccatttctgggggatggagaggcaataccaatagcggtaacctcagactgcgtttccttccc

SEQ ID NO: 750 - DNA, 1941 bp, Unknown
  derived from dsRNAs of unknown virus
tgttttctccctctgggtgacgtccgacgtccgggtgttgcacgtgacgcaatcgttgaccgcgtgaaggttcgtttgtgtacgtgacacacacggtagccacgtgatagctcgctagttgcagcgttagcaacggttgacggcctaagttcgtagccactacgcgtaagtgagtggcgtgcgtcgctgccgtatacagcgaccgattaatccacgttatggattcgagtaacctcacgacacgaggttcgcaactcacgagcgtgagagtgaggggttggtcacctagtggaataacccgtcagaccacagacgttagatgtggtcaactgagtgtaagagcttcccgggcttacactgtgtgcaagggacctcccagctggatcgctggcggccacgttgtggtcagtatgatcatccaccaggtatcagcgcctggaaaaggagtagactgatggaaaacatctcatccgcttcctcacttgaacaagtgagcgcgagactccaggaacttggcaatgctgcagttcctgtgcccgccgagaccgtgaaggttgaggctctagtttcagaccttgatggtctggaggtcatggccagagtcttctatgaagagctggtcgttgctctgggaggaaggttctcaatgacgcaagcggatgtgttggatgcactgaagtttgtgattgagttgaggattttccaagttcgtcgcgaactaccaggctcgatcacgctgaggaacattgagttcccagctgctctcctcccgatagtgctggctatcggtacagtggacgttgacaggaccatagagatcatccccgcactgggagactctaatgggaatgttattccagtcactgtgtggttgaaaaactacgaggagaggctccaaagactcgaaaccttagttcgctacttgtcaacacctgacctcagggccgagcttgcgtacatgccgcgcgacactcgcggatcccttgacttctatgcgttcatcgcagaggggtctgatctccgtaccgatcacgcaacacgtgatcgtgtaatggcggtgtttcgcagtgtactaaggctcacactaacgccttgggtttggggaagaccggtttggagctacggtgccatcgaccttctgaagcaggaagtacgggcgttcacacgaaataccatacgtggacgtcttaaggtgatgccatgaaggaacttgggcacttcttggtggtcgccttagtggcggttcttccaccgttcattagtgtcttcctgtggatggaactggctccccatgtgggggctgactatagcctcctgctcctattaggcatagcggtcacgacgaacctaataggattcctctacgcttgttggctctatgggtctgaggtgggcgatctcttcgcgcacaccttaggagcgtggtctccaaagttggataccgaggtaaagaagctcgaatccaacttacgtcgtcttgagaaactgcgctctgagctcgagcaatccgtggaaaaagctcgaaaagaactcacccatctagatccattcgttgacgacgtcttaactcaactcgacaaattggcaccagcatacgctgagaggatctcagactggatcattgatgcaattgatcggtggtggccaacagtggagagttatactaactcaacactgaagaccatcgagaaagacatctttggcagtgtcgagagactcaggcgtgtgtggtttctcacgttgccttttgttgaggagttgagtaagctaccagctgaggaacgctgtaaggcgctgaatctctggttcgaaggactagagggtcaacaagaaaagtggagggaactggcagaatacttccgtaagagatcacggaagtagagcagacgaagaggacccacggttgtcgttccctggtggccggccagagccgccaccaca

SEQ ID NO: 751 - DNA, 1620 bp, Unknown
  derived from dsRNAs of unknown virus
tgttttccttccccaaggtctgaccccctgaccggtccgtgatgtcgctagcgtgagcctatggcgcgacaactttgatttggactgcccgaccaaatcaagagtgtagggtcccaccaactggattgttggccaccatgtcatggtgagtacgatcatccactggactagtatccagtaaggagaagaacgatggaaaagaaagccatctcatccgcaccgtcacttgaacaagtgaccgcgagactgcaggacctcggcaacgctgcggttcctgttgccatcgagactgttacagtcgaggcagtagtttcagacctcaacggtctggaagtcatggctcgtgtctttcacgacgagctcaaatcagccttaggttccaggtacgatctaacactggacgatgtgcttgacgcactaaagttcgtcgttgaactaaggatattccaagttcgacgtgatctgcctgggactatcaacctaaggagtattgagttcccggcgtcgttactcccaatagtgctagctattggtgtcgttgatgtcgatcgtaccattgagatcatccccgcactaggagactcaactggaaaggtcgttaacgtcaaggactggctgagaagctatgagtcacgacttggaaagctcgaggctttagttcgttacttggctgcacccgacttaagggttgagttgtcttacatgccaagggacaccaatgggtctcttgatttctatgcctttatggccgagggaccagatctccgcactgacagatccacaagggatcgagtgatggcggtgttccgtagcgtgttgcggctcacactaacgccctgggtttggggtaggccggtatggagctatggcacgattgatcttctgaagcaggagattaaggcattcactcgggccacgatacgtggcaccacgcgagttgttccatgaaaggtattctctacctgcttggaactataatctacgcggtgatccctggtgtcctgccaatcgaactgtggatgatgctaccctccgcactaggtggaggtcaaagcctcgtggtcttatcaggtttgacaattgggatcaacctgatatgtgtcttcattctcaagtggttggatggttcagatgccggtacattcttcgtacaggtatttggtgactgggaagctcaactcaaggaaaagctcattgagttgaacagaacagacatggatatttacaaactgctgcgtgagatgcaggaatatctgaccagctccgatcctatagtgaagagagtctctcgagacctcgataggttagtagagcctgttgcaaaaggtattgagcagcactttcaacaaaaggttaaggaaatcctaaaccaattggatgagagtgttgtccaaactagatcaacctggttcgaaagtctaccttttgtggatgacatacgtcagctgtctgaaggaaagaggggtgaagctcttgagctctggttcaaaggattggagggagaccctgagaagtggaggcaactggcagaatacttccgcaagagatctcggaagtaaaaccactgaagaaggctgtcagtcttgaggtgttgcgagcgacgccagcgcccgcacctca

SEQ ID NO: 752 - DNA, 55 bp, Artificial Sequence
  PC3-T7 loop primer
ggatcccgggaattcggtaatacgactcactatatttttatagtgagtcgtatta

SEQ ID NO: 753 - DNA, 17 bp, Artificial Sequence
  PC2 primter
ccgaattcccgggatcc

The invention claimed is:

1. A method for determining an RNA sequence, which comprises:
    separating double-stranded RNA (dsRNA) in a sample from DNA and single-stranded RNA to obtain purified dsRNA;
    randomly fragmenting the purified dsRNA to obtain dsRNA fragments, wherein the obtained dsRNA fragments have a 150- to 5000-base length;
    subjecting the obtained dsRNA fragments to a reverse transcription reaction starting from the 3' ends of the dsRNA fragments, and then performing polymerase chain reaction (PCR) to obtain corresponding DNA fragments;
    subjecting the obtained DNA fragments to a sequence analysis operation to determine sequences of the fragments; and
    comparing the determined sequences with a known virus sequence.

2. The method according to claim 1, wherein the purified dsRNA is mechanically, enzymatically, or chemically fragmented.

3. The method according to claim 2, wherein the purified dsRNA is mechanically fragmented by ultrasonication.

4. The method according to claim 1, wherein the purified dsRNA is fragmented so that phosphate groups are not left at the 3' ends of the dsRNA fragments to be obtained.

5. The method according to claim 4, which further comprises ligating a loop primer to the 3' ends of the dsRNA fragments to obtain primer-ligated dsRNA fragments, and wherein:
the obtained primer-ligated dsRNA fragments are subjected to a reverse transcription reaction, and then polymerase chain reaction (PCR) is performed.

6. The method according to claim 1, wherein the purified dsRNA is derived from an RNA virus.

7. The method according to claim 6, wherein the method further comprises determining a full-length genome sequence of the RNA virus based on the sequences of the fragments.

8. The method according to claim 6, wherein the RNA virus contained in the sample is an unknown RNA virus.

9. The method according to claim 1, wherein the obtained dsRNA fragments have a 1000 to 4000-base length.

10. A method for preparing DNA fragments, which comprises:
separating a double-stranded RNA (dsRNA) in a sample from DNA and single-stranded RNA to obtain purified dsRNA wherein the obtained dsRNA fragments have a 150-5000 base length;
randomly fragmenting the purified dsRNA to obtain dsRNA fragments; and
subjecting the obtained dsRNA fragments to a reverse transcription reaction starting from the 3' ends of the dsRNA fragments and then performing polymerase chain reaction (PCR) to obtain corresponding DNA fragments.

11. The method according to claim 10, wherein the purified dsRNA is derived from an RNA virus.

12. A method for analyzing a virus, which comprises:
separating dsRNA in a sample from DNA and single-stranded RNA to obtain purified dsRNA;
randomly fragmenting the purified dsRNA to obtain dsRNA fragments, wherein the obtained dsRNA fragments have a 150- to 5000-based length;
subjecting the obtained dsRNA fragments to a reverse transcription reaction starting from the 3' ends of the dsRNA fragments, and then performing polymerase chain reaction (PCR) to obtain corresponding DNA fragments;
subjecting the obtained DNA fragments to a sequence analysis operation to determine sequences of the fragments; and
analyzing presence or absence and/or characteristic of a virus in the sample on the basis of the determined sequences.

13. The method according to claim 12, wherein the sample is derived from an organism or environment.

* * * * *